United States Patent 11,141,474 (ARTIFICIAL NUCLEIC ACID MOLECULES ENCODING A NOROVIRUS ANTIGEN AND USES THEREOF) - sequence listing, part 4

SEQ ID NO: 7938 - RNA, 1617 nt, Artificial Sequence
  VP1__Norovirus_and/or_Norovirus-like__KP698925
augaagauggcgucgagugacgccaacccaucugauggguccgcagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguguccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuaccugauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauuuucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaaacuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuuauaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7939 - RNA, 1617 nt, Artificial Sequence
  VP1__Norovirus_and/or_Norovirus-like__LC005727
augaagauggcgucgagugacgccaacccaccugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcaguuccaccaaauuuuccaacugaaggcuugagccccagccaggucacuauguucccccauauaguaguggauguuaggcaacuagaaccuguguugauucccuuacccgauguuaggaauaacuucuaucauuacaaucaaucaaaugacccuaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggggaugucacccauaucacagguagucauaacuacacaaugaauuuggcuucucaaaauuggaacaauuaugacccaacagaagaaaucccagccccucuaggaacuccagauuuuguggggaaaauucaaggcgugcucacccaaaccacaaggacagauggcucaacacgcggccacaaagcuacaguguacacugggagcgccgacuuugcuccaaaacuggguagaguucaauuugaaacugacacaaaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7940 - RNA, 1617 nt, Artificial Sequence
  VP1__Norovirus_and/or_Norovirus-like__LC016603
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuucaggcacuaguacuuacagaaugaauuuggcuucucaaaauuggaacaauuaugacccaacagaagaaaucccagccccucugggaacuccagauuucgugggaaagauccaaggcaugcucacccagaccacaaagggagacggcucgacccgcggucacaaagcuacagugagcacugggagugucgacuucacuccaaagcugggcagcguucaguucgccacugauacagacaaugauuuugaaacuggccaaaacacaagguucaccccagucggugucauccaggaugguaguggugcccacagaaaugaaccccaacaauggguacucccagauuacucagguaaaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacguuaa

SEQ ID NO: 7941 - RNA, 1617 nt, Artificial Sequence
  VP1__Norovirus_and/or_Norovirus-like__LC016599
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuccaagcacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacguuaa

SEQ ID NO: 7942 - RNA, 1617 nt, Artificial Sequence
  VP1__Norovirus_and/or_Norovirus-like__KP293587
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgccccugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguggauguuaggcaacuaaaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuuccugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucauagcuacacaaugaauuuggcuucucaaaauuggagcaauuaugacccaacagaagaaaucccagccccucuaggaacuccagauuuugugggcaagauccagggcgugcucacccaaaccacaaggacagauggcucaacacgcggccacaaagccacaguguacacugggagcgccgacuuugcuccaaaacuggguagaguucaauuugaaacugacacaaaccaugauuuugaagcuaaccaaaacacaaaguucaccccaguuggugucauccaagaugguagcaccacccaccgaaaugaaccccaacagugggugcucccaaguuacucaggcagaaauacucccaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcggccccagcacaaucugauguggcucugcuaagauuugugaauccagacacagguaggguuuuguuugaguguaagcuucauaaaucaggcuauguuacaguggcucacacuggccaacaugauuugguuauuccccccaaugguuauuuuagguuugauuccugggucaaccaguuuuacacgcuugcccccaugagaaauggaacggggcguagacguuaa

SEQ ID NO: 7943 - RNA, 1617 nt, Artificial Sequence
  VP1__Norovirus_and/or_Norovirus-like__KP176402
augaagauggcgucgagugacgccaacccaucugauggguccgcagccaaccucgucccagaggucaacaaugagguuauggcuuuggagcccguuguuggugccgccauugcggcaccuguagcgggccaacaaaauguaauugaccccuggauuagaaauaauuugguacaagccccugguggagaguuuacaguauccccuagaaacgcuccaggugaaauacuauggagcgcgcccuugggcccugagcuaaaucccuaccuaucccauuuggccagaauguacaaugguuaugcagguggcuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagauguuacccauaucacagguagucguaacuacacaaugaacuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccgguugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7944 - RNA, 1617 nt, Artificial Sequence
  VP1__Norovirus_and/or_Norovirus-like__KJ196287
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaauaauuuuguacaagccccugguggagaguuuacaguauccccuagaaacgcuccaggugaaauauuauggagcgcgcccuuaggcccugauuugaaucccuaccuuucccauuuggccagaauguauaaugggcaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguucucacgaggccauccccugauuuugauuuuauauuuuuggugccaccuacaguugagucaaggacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcucccuuuacuccaaagcugggcaguguucaguucaguacugacacagaaaaugauuuugaaacucaccaaaacacaaaauucaccccagucggugucauccaggaugguggcaccacccaccgaaaugaaccccaacaauggguacucccaaguuauucagguagaaauguccacaauguacaccuagccccugcuguagcccccacuuuuccgggugaacagcuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccucuuugagugcaaacuccauaaaucaggcuaugucacaguggcucacaccggccagcaugauuuggucaucccccccaaugguuauuuuagguuugauuccuggguuaaucaauucuacacacuugcccccaugggaaauggaacggggcguagacguuaa

SEQ ID NO: 7945 - RNA, 1617 nt, Artificial Sequence
  VP1__Norovirus_and/or_Norovirus-like__KM198480
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaacaauuuuguacaagccccugguggagaguucacaguaucuccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauugauagcaaugcuguauacaccacuuagggccaacaaugcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcuaggcaguguucaauucaguacugacacagaaaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuuuauaaaucaggcuaugucacaguggcucacaccggucagcaugauuuggucaucccccccaauggcuauuuuagguuugauuccuggguuaaucaguucuacacgcucgcccccaugggaaacggaacggggcguaggcgcuaa

SEQ ID NO: 7946 - RNA, 1617 nt, Artificial Sequence
  VP1__Norovirus_and/or_Norovirus-like__KJ716357
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaacggacaugcaggcgguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaacuucuaucauuacaaccaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucagucccaguuuuaacuguugaggagaugaccaauucaagauuccccauuccuuuggaaaaguuguucacggguccuagcagcgccuuuguuguccaaccacaaaacggcaggugcacgacugauggcgugcuccuaggcaccacccaacugucuccugucaacaucugcaccuucagaggggaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7947 - RNA, 1617 nt, Artificial Sequence
  VP1__Norovirus_and/or_Norovirus-like__KJ716354
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaucuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgaugucaggaauaauuucuaucauuauaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacagucgagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcguacuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacauugggagcgccgacuucgcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucagguagaaauacucauaaugugcaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7948 - RNA, 1617 nt, Artificial Sequence
  VP1__Norovirus_and/or_Norovirus-like__KJ685403
augaagauggcgucgagugacgccaacccaucugauggguccacagccaaccucgucccagaggucaacaaugagguuauggcuuuggagcccguaguuggugcugcuauugcggcaccuguagcgggccagcaaaauguaauugaccccuggauuagaaacaauuuuguacaagccccugguggagaguuuacaguauccccuagaaacgcuccaggugagauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgacgucuucacaguuucuugucgaguccucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuuaccacugacacagacaaugauuuuguaacuaaccaaaacacgaaguucaccccagucgguguuauccaggaugguaguacuaccccccgaaacgaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcgcuguuaagauuugugaauccagacacagguaggguuuuguuugaguguaagcuucauaaaucaggcuauguuacaguggcucacacuggccaacaugaucuaguuaucccccccaaugguuauuuuagauuugauuccugggucaaccaguucuacacacuugcccccaugggaaaugggacggggcguagacguuaa

SEQ ID NO: 7949 - RNA, 1617 nt, Artificial Sequence
  VP1__Norovirus_and/or_Norovirus-like__KF060108
augaagauggcgucgagugacgccaacccaucugauggguccucagccaaccucgucccagaggucaacaaugagguuauggcuuuggagcccguaguuggugccgcuauugcggcaccuguagcgggccagcaaaauguaauugaccccuggauuagaaacaauuuuguucaagccccugguggagaguucacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaaugcguucaccgccgggaaaaucauauuugcagcagucccaccaaauuucccaaccgaagguuugagccccagccaagucacuauguucccccacauaauaguagauguuaggcaauuggaaccuguguugauccccuuacccgauguuaggaauaauuucuaucauuauaaucagucaaaugaccccacuaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccaucccuuuggaaaaguuauucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagaaaucccagccccccugggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucggugucauccaggaugguagcacuaccccccgaaaugaaccccaacaaugggugcuuccaaguuacucaggcagaaacacucauaaugugcaccuggcccccgcuguggcccccacguucccgggcgagcagcuccucuucuucagaucuaccaugcccggaugcagcggguaccccaacauggauuuggacugucugcucccccaggaaugggugcaguauuucuaccaggaggcagccccagcacaaucugauguggcgcuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguaaacguuaa

SEQ ID NO: 7950 - RNA, 1617 nt, Artificial Sequence
  VP1__Norovirus_and/or_Norovirus-like__KF060099
augaagauggcgucgagugacgccaacccaucugauggguccacggccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagugcgcccuuaggcccugauuugaaucccuaccuuucccauuuggccagaauguacaaugguuaugcgggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaccagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacauuugcaccuucagaggggaugucacccacauuccaggcagucguaacuacacaaugaauuuggccucccaaaauuggaacagcuacgacccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaaguuacucaggcagaaacacucacaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7951 - RNA, 1617 nt, Artificial Sequence
  VP1__Norovirus_and/or_Norovirus-like__KF060004
augaagauggcgucgagugacgccaacccaucugauggguccguagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacaagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagccguaacuacacaaugaauuuggcuucucaaaauuggaacaauuaugacccaacagaagaaauuccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaacacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcccacacuggccaacaugauuugguuaucccccccaaugguuauuuuagguuugauuccugggucaaccaguuuuacacgcuugcccccaugggaaauggaacggggcguagacguuaa

SEQ ID NO: 7952 - RNA, 1617 nt, Artificial Sequence
  VP1__Norovirus_and/or_Norovirus-like__KF060006
augaagauggcgucgagugacgccaacccaucugauggguccacagccagccucgucccagaggucaacaaugagguuauggcguuggagcccguaguuggugccgccauugcggcaccuguagcgggccaacaaaauguaauugaccccuggauuagaaacaauuuuguacaagccccugguggagaguucacaguaucccccagaaacgcuccaggugaaauacuauggagcgcgcccuuaggcccugaucugaaucccuaccuuucccauuuggccagaauguacaauaguuaugcaggugguuuugaagugcaaguaauccucgcggggaacgcguucaccgccgggaaaaucauauuugcagcagucccaccaaauuucccaacugaagguuugagccccagccaggucaccauguucccccacauaauaguagauguuaggcaauuggaaccuguguuaauucccuuacccgauguuaggaauaauuucuaucauuauaaccagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccagcugucucccgucaacaucugcaccuucagaggggaugucacccauauuucaggcagccacaacuacacaaugaauuuggccucccaaaauuggaacaguuacgacccaacagaagaaaucccagccccucuagggacuccagauuucguggggaagauucaaggugugcucacccaaaccacaaggauaaauggcucgacccgcggucacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccucaacaaugggugcucccuaguuacucaggcagaaacacucauaacgugcaccuggcccccgcuguagcccccacuuucccgggcgagcagcuccucuucuucagauccacuaugcccggaugcagcggguaccccaacauggacuuggacugucugcucccccaggaaugggugcaguauuucuaccaggaggcagccccagcacaaucugauguggcucugcugagauuugugaacccagacacagguagggucuuguuugaguguaagcuccauaaaucaggcuauguuacaguggcucacacuggccaacaugauuugguuaucccccccaaugguuauuucagauuugauuccugggucaaccaguucuacacacuugcccccaugggaaaugggacggggcguagacguuaa

SEQ ID NO: 7953 - RNA, 1617 nt, Artificial Sequence
  VP1__Norovirus_and/or_Norovirus-like__KC517371
augaagauggcgucgaaugacgccaacccaucugauggguccgcagccaaccucgucccagaggucgacaaugagguuauggcuuuggagcccguugucggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaccccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguccucacgaggccauccccugauuuugauuucauauuuuuggcgccaccuacaguugagucaagaacuaagccauucacugucccaauccuaacuguugaagaaaugaccaauucaagguucccaauuccuuuggagaaguuguucacgggucccagcagugccuuuguuguucaaccacaaaauggcagaugcacaacugauggcgugcucuuaggcaccacccagcugucucccgucaacaucugcaccuucagaggggaugucacccacauugcagguucucguaauuacacaaugaauuuggcuucucuaaauuggaacaacuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuccuuuucuuuagguccacuaugcccggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcaugauuuggucauuccccccaaugguuauuuuagguucgauuccuggguuaaccaauucuacacgcuugcccccaugggaaacggaacggggcguagacguuaa

SEQ ID NO: 7954 - RNA, 1617 nt, Artificial Sequence
  VP1__Norovirus_and/or_Norovirus-like__JX459657
augaagauggcgucgagugacgcccacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaguaguagauguuaggcaauuggaaccuguguugauccccuuacccgauguuaggaauaauuucuaccauuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagauaaugauuuuguaacuaaccagaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaucccaacauggauuuggacugucugcucccccaggaaugggugcaguauuucuaccaggaagcagccccagcacaaucugauguggcacuguuaagauuugugaauccagacacagguaggguuuuguuugaguguaagcuucauaaaucaggcuauguuacaguggcucacacuggccaacaugauuuaguuauccccccuaaugguuauuuuagauuugauuccugggucaaccaguucuacacacuugcccccaugggaaaugggacggggcguagacguuaa

SEQ ID NO: 7955 - RNA, 1617 nt, Artificial Sequence
  VP1__Norovirus_and/or_Norovirus-like__JX459656
augaagauggcgucgagugacgcccacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccacuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccacuauaaucaaucaaaugaccccaccaucaaauugauagcaauguuguauacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguuuacgggucccaguagugccuuuguuguucaaccacaaaacggcaggugcacgacugauggcgugcuccuaggcacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaacaacaaggacaaauggcucgacucgcggccacaaagcuacaguguacacugggagcgccgacuuuucuccaaaacuggguagaguucaauuugccacugacacagacaaugauuuugaaacuaaccaaaacacaaaguuuaccccagucggcguuauccaggauggcaguacuaccccccgaaaugaaccccaacaaugggugcucccaaguuacucaggcagaaacauucauaaugugcaccuggcccccgcuguggcccccacuuucccgggcgagcagcuccucuucuucagaucuacuaugcccggaugcagcggguaccccaacauggauuuggacugccugcucccccaggaaugggugcaguacuucuaccaggaggcagccccagcacaaucugacguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7956 - RNA, 1617 nt, Artificial Sequence
  VP1__Norovirus_and/or_Norovirus-like__JX445152
augaagauggcgucgaaugacgccaacccaucugauggguccacagccaaccucgucccagaggucaacaaugagguuauggcuuuggagcccguuguuggugccgcuauugcggcaccuguggcgggccaacaaaauguaauugaccccuggauuagaaauaauuuuguacaggccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccagucaaaugaccccaccauuaaauugauagcaaugcuguacacaccacuuagggcuaauaaugcuggggaagaugucuucacagucucuugucgaguccucacgaggccauccccugauuuugauuuuauauuuuuggugccacccacaguugagucaagaacuaaaccauucaccgucccaauuuuaacuguugaggaaaugaccaauucaagauucccuauuccuuuggaaaaguuguucacggguccuagcggugccuuuguuguucaaccacaaaauggcaggugcacgacugauggcguacucuuaggcaccacccaacugucuccugucaacaucugcaccuucagaggggaugucacccacauugcagguacucauaauuacacaaugaauuuggcuucucaaaauuggaacaauuaugacccaacagaagaaaucccagccccucuggggaccccagauuucgugggaaggauccaaggcaugcucacccaaacuacaaggggagauggcucuacccgcggccacaaagcuacagugagcacuggggauguccacuucacuccaaagcugggcaguauucaauucaacacugauacaaacaaugauuuugaagcuggccaaaacacgaaauucaccccagacgguguuguccaggaugguaaugguacccaccaaaaugaaccccaacaaugggugcucccaagcuacucagguagaacuggucauaauguacaccuagcccccgccauagcccccacuuuuccgggugagcaacuucuuuucuucagguccacuaugcccggaugcagcggguaccccaacaugaauuuggauugucuacucccccaagaaugggugcagcacuucuaccaagaggcggcuccagcacaaucugauguggcucugcuaagauuugugaauccagacacggguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacguuaa

SEQ ID NO: 7957 - RNA, 1617 nt, Artificial Sequence
  VP1__Norovirus_and/or_Norovirus-like__JQ613553
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggucugagccccagccaggucacuauguucccccauauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuuccugucgaguucucacgagaccaucccccgauuuugauuucauauuuuuggugccacccacaguugaaucaagaacuaaaccauucucugucccaguuuuaacuguucaggagaugaccaauucaagguuccccauuccuuuggaaaaguuguucacaggccccaguagugccuuuguuguucaaccacaaaacggcaggugcacgacugauggcgugcuccuagguacuacccaacugucuccugucaacaucugcaccuucagaggggaugucacccauauuccagguagucguaacuacacaaugaauuuggccucccaaaauuggaacaguuacgacccaacagaagaaaucccagccccucuaggaacuccagauuucguggggaagauucaaggugugcucacccaaacuacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauccauaaugugcaccuggcccccgcuguagcccccaccuucccgggcgaacagcuccucuucuucagaucuacuaugcccggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7958 - RNA, 1617 nt, Artificial Sequence
  VP1__Norovirus_and/or_Norovirus-like__JQ613521
augaagauggcgucgaaugacgccaacccaucugauggguccgcagccaaccucgucccagaggucagcaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggccaauaaugcuggggaagaugucuucacagucucuugucgaguccucacgagaccauccccugauuuugauuuuauauuuuuggugccacccacaguugagucaagaacuaaaccauuuacugucccaaucuuaacuguugaagaaaugaccaauucaagauuccccauuccauuggaaaaguuguucacgggucccagcggcgccuuuguuguccaaccacaaaauggcaggugcacgacugauggcgugcucuuaggcaccacccaacuguccccugucaacaucugcaccuucagaggggaugucacccacauugcagguucucgugauuacacaaugaauuuggcaucucuaaauuggaacaauuaugacccaacagaagaaacuccagccccucugggaacuccagauuucgugggaaagauccaagguaugcucacucaaaccacaaagggagauggcucgacccguggccauaaagcuacaguuuacacugggagugcccccuuuacuccaaagcugggcaguguucgauucaguacugauacagaaaaugauuuugaaacucaccaaaacacaaaauucaccccagucggugucauccaggaugguagcaccacccaccgaaaugaaccccaacaaugggugcucccaaguuauucagguagagacguccauaauguacaccuagccccugcuguagcccccacuuuuccgggugaacaacuucuauucuucagguccacuaugcccggaugcaguggguaucccaacauggauuuggauugccuacucccccaggagugggugcagcacuucuaccaagaggcagcuccagcacaaucugauguggcccuauugagauuugugaauccagauacggguaggguccuguuugagugcaaacuucauaaaucaggcuaugucacaguggcucacaccggccagcaugauuugguuaucccccccaaugguuauuuuagguuugauuccugggucaaucaauucuacacacuugcccccaugggaaauggaacggggcguagacguuaa

SEQ ID NO: 7959 - RNA, 1617 nt, Artificial Sequence
  VP1__Norovirus_and/or_Norovirus-like__HQ005298
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuguccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauucccuuacccgauguuagaaauaauuucuaccauuauaaucaaucaaaugaccccaccaucaaauugauagcaauguuguacacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacugauggcgugcuccuagguacuacccaacugucuccugucaacaucugcaccuucagaggggaugucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccguggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguagcaccaccccccgaaaugaaccccaacaaugggugcucccaaguuauucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucuguuaagauuugugaauccggacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7960 - RNA, 1617 nt, Artificial Sequence
  VP1__Norovirus_and/or_Norovirus-like__HQ005296
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuguccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauucccuuacccgauguuagaaauaauuucuaccauuauaaucaaucaaaugaccccaccaucaaauugauagcaauguuguacacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccguggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuauucaggcagaaacacucauaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucuguuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7961 - RNA, 1617 nt, Artificial Sequence
  VP1__Norovirus_and/or_Norovirus-like__HM802555
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguauccccuagaaacgcuccaggugaaauauuauggagcgcgcccuuaggcccugaucugaauccauaccuuucucaccuggccagaauguacaaugguuaugcaggugguuuugaagugcagguaauccucgcggggaacgcguucaccgcugggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuauaaucaaucaaaugacuccaccauuaaauugauagcaaugcuguacacgccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaaugguaggugcacgacugauggcgugcucuuaggcacuacccaacugucccccgucaacaucugcaccuucagaggggaugucacccacauuccagguacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuuuacuccaaagcugggcagcguucaguucgccacugauacagacaaugauuuugaaacuggccaaaacacaagguucaccccaguuggugucauccaggaugguaguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacagucugauguggcuuugcugagauuugugaauccagacacagguaggguuuuguuugagugcaagcuucauaaaacaggcuaugucacaguggcucacacuggccagcaugauuugguuaucccccccaauggcuauuuuagauuugauuccugggucaaccaguucuacacacuugcccccaugggaaauggagcggggcguagacguuaa

SEQ ID NO: 7962 - RNA, 1617 nt, Artificial Sequence
  VP1__Norovirus_and/or_Norovirus-like__GQ246801
augaagauggcgucgagugacgcccacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaagcuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcuuacacuggccaacaugauuugguuaucccccccaaugguuauuuuagauuugauuccugggucaaccaguucuacacacuugcccccaugggaaaugggacggggcguagacguuaa

SEQ ID NO: 7963 - RNA, 1617 nt, Artificial Sequence
  VP1__Norovirus_and/or_Norovirus-like__AB504308
augaagauggcgucaaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuugugcaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuuuccaacugaaggcuugagccccagccaagucacuauguucccccauauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuccagguacucguacuuacagaaugaaucuggcuucucaaaauuggaacaauuaugacccaacagaagaaaucccagccccucugggaacuccagauuucgugggaaagauccaaggcaugcucacccaaaccacaaagggagacggcucgacccacggucacaaagcuacagugagcacugggagugucgacuucacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacguuaa

SEQ ID NO: 7964 - RNA, 1617 nt, Artificial Sequence
  VP1__Norovirus_and/or_Norovirus-like__DQ369797
augaagauggcgccgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuugugcaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugauuccaccauuaaauugauagcaaugcuguacacaccacuuagggccaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucagcaucugcaccuucagaggcgaugucacccacauuccagguacucguauuuacagaaugaauuuggcuucucaaaauuggaacaauuaugacccaacagaagaaauuccagccccucugggaacuccagauuucgugggaaagauccaaggcaugcucacccaaaccacaaagggagacggcucgacccgcggucacaaagcuacagugagcacugggaguguugacuucacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaauggguacagcacuucuaccaagaggcagccccaucacaaucugacguggcuuugcugagauuugugaauccagacacaggcaggguucuguuugagugcaagcuucauaaagcaggcuaugucacaguggcgcacacuggccagcaugauuugguuaucccccccaauggcuauuuuagauuugauuccugggucaaccaguucuacacacuugcccccaugggaaauggagcggggcguagacguuaa

SEQ ID NO: 7965 - RNA, 1617 nt, Artificial Sequence
  VP1__Norovirus_and/or_Norovirus-like__LC177661
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaguaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcagggaaugcguucaccgccgggaaggucauauuugcagcagucccaccaaacuuuccaacugaaggcuugagccccagucaggucacuauguucccccauauaguaguagauguuaggcaauuagaaccuguguugauucccuuacccgauguuaggaauaauuucuaucauuacaaucaaucaaaugacccuacuauuaaauugauagcaauguuguauacaccacuuagggcuaauaaugcuggggaugaugucuucacaguuucuugcagaguucucacgagaccauccaccgauuuugauuucauauuccuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacucucuccugucaacaucugcacguucagaggagaugucacccauaucacagguagucguaacuacacaaugaaucuggcuucucaaaauuggaacaauuaugacccaacagaagaaaucccagccccucuaggaacuccagauuuuguggggaagauucaaggcaugcucacgcaaaccacaaggacagauggcucaacacgcggccacaaagcuacaguguauacugggagcgccgacuuugcuccaaaacuggguagaguucaauuugaaacugacacagaccaugauuuugaagcuaaccaaaacacaaaguucaccccaguuggugucauccaagaugguagcaccacccaccgaaacgaaccccaacagugggugcucccaaguuacucaggcagaaauacuccuaaugugcauuuggcccccgcuguggcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuccauaaaucaggcuauguuacaguggcucacacuggccaacaugauuugguuaucccccccaaugguuauuuuagguuugauuccuggguaaaccaguuuuacacgcuugcccccaugggaaauggaacggggcguagacguuaa

SEQ ID NO: 7966 - RNA, 1617 nt, Artificial Sequence
  VP1__Norovirus_and/or_Norovirus-like__LC175468
augaagauggcgucgagugacgccaacccaucugauggguccgcagccaaccucguaccagaggucaacaaugagguuauggcuuuggagcccguuguuggugccgcuauugcggcaccuguagcgggccagcaaaauguaauugaccccuggauuagaaauaauuuugugcaagccccugguggggaguuuacaguauccccuagaaacgcuccaggugaaauacuauggagcgcgccccuaggcccugaccuaaaucccuaccuaucccauuuggccagaauguacaaugguuaugcaggugguuuugaagugcagguaauucucgcggggaacgcguucaccgccgggaagaucauauuugcagcagucccaccaaacuuuccaacugaaggcuuaaguccuagccaggucacuauguucccccauauaauaguggauguuagacaauuagaaccugugcugauucccuuacccgaugucaggaauaauuucuaucauuacaaucagucaaaugauuccacuauuaaguugauagcaauguuguauacaccacuuagggcuaauaaugcuggggaugauguuuucacaguuucgugccgaguucucacgagaccaucccccgauuuugauuucauauuuuuagugccacccacaguugagucaagaacuaaaccauucucugucccaguuuuaacuguugaggagaugaccaauucaagauuucccauuccuuuggaaaaguuguucacgggccccagcagugccuuuguuguucaaccacaaaacggcaggugcacaacugauggcgugcuucuaggcaccacccaacugucuccugucaacaucugcaccuucagaggggaugucacccacaucacagguagucgcaacuacacaaugaauuuggcuucucaaaauuggaacaacuaugacccaacagaagaaaucccagcaccucuaggaacuccagauuuuguggggaagauccaaggcaugcucacccaaaccacaaggacagaugguucaacacgcggccacaaagcuacaguguacacugggagcgccgacuuugcuccaaaacuggguagaguucaauuugaaaccgacacagaccaugauuuugaagcuaaucaaaacacaaaguucaccccagucggugucauccaagaugguagcaccacccaccgaaacgaaccccaacagugggugcucccaaguuacucaggcagaaauacucacaauguacaucuagcccccgcuguagcccccaccuuuccgggugagcaacugcucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguuaa

SEQ ID NO: 7967 - RNA, 1617 nt, Artificial Sequence
  VP1__Norovirus_and/or_Norovirus-like__KX354137
augaagauggcgucgagugacgccaacccaucugauggguccgcagccaaccucgucccagaggucagcaaugagguuauggcucuggagcccguuguuggugccgccauugcggcaccuguagcgggccaacaaaauauaauugaccccuggauuagaaacaauuuuguacaagccccugguggagaguuuacaguguccccuagaaacgcuccaggugagauacuauggagcgcgcccuuaggcccugauuuaaaucccuaccuaucccauuuggcuagaauguacaaugguuaugcagguggcuuugaagugcagguaauccucgcggggaacgcguucaccgccgggaagaucauauuugcagcagucccaccaaauuuuccaacugaaggcuugagccccagccaggucacuauguucccccacauaauaguggauguuaggcaauuagaaccuguguugauucccuuaccugauguuaggaauaauuuuuaccauuauaaucaaucaaaugaccccacuauuaaguugauagcaauguuguauacaccacuuagggcuaauaaugcuggggacgaugucuucacgguuucuugccgaguucucacgagaccaucccccgauuuugauuucauauuucuagugccacccacaguugagucaagaacuaaaccauucucugucccaaucuuaacuguugaggagaugaccaauucaagauuucccauuccuuuggaaaaguuguucacgggucccagcagugccuuuguuguccaaccacaaaauggcagaugcacgacugauggcgugcuccuagguaccacccaguuaucuccugucaacauuugcaccuucagaggggaugucacccauaucacagguagccauaacuacacaaugaauuuggcuucucaaaauuggaacaauuaugacccaacagaagaaaucccagccccucuaggaacuccagacuuuguggggaagauucaaggugugcucacccaaaccacaaggucggauggcucgacacgcggccacaaagccacaguguacacugggagcgccgacuuugcuccaaaacuggguagaguucaauuugaaacugacacagaccgugauuuugaaacuaaccaaaauacaaaauucaccccagucggugucauccaagaugguaccacugcccaccgaaaugaaccucaacagugggugcucccaaguuauucaggcagaaacauucauaaugugcaccuggcccccgcuguagcccccacuuuuccgggugagcaacugcucucuuucagguccacuaugcccggaugcagcggguaucccaacauggauuuggacugucugcuuccccaggaaugggugcaguacuucuaccaagaggcagccccagcacaaucugauguggcucuguuaagauuugugaauccagacacagguaggguuuuguuugaguguaaacuucauaaaucaggcuauguuacaguggcucauacuggccaacaugauuugguuauuccccccaaugguuacuuuagauuugauuccuggguuaaucaguucuacacgcuugcccccaugggaaauggaacggggcguagacguuaa

SEQ ID NO: 7968 - RNA, 1617 nt, Artificial Sequence
  VP1__Norovirus_and/or_Norovirus-like__KX354036
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaccccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugcuggggacgaugucuucacaguuucuugucgaguucucacgagaccaucccccgacuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaauuguccccuguuaacaucugcaccuucagaggggaugucacccauauuccaggcagucguaacuacacaaugaauuuggccucccaaaauuggaacaguuacgauccaacagaagaaaucccagccccucugggaucuccagauuucguggggaagauucaaggugugcucacccaaaccacaaggacaaauggcucgacccgcggccacaaagcuacaguguauacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaagaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuauuccccccaaugguuauuuuagauuugauuccugggucaaccaguucuacacacuugcccccaugggaaaugggacggggcguagacguuaa

SEQ ID NO: 7969 - RNA, 1617 nt, Artificial Sequence
  VP1__Norovirus_and/or_Norovirus-like__KX354011
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaagcaauuuuguacaagccccugguggagaguuuacaguauccccuaggaacgcuccaggugaaauacuauggagcgcgcccuuaggccccgauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggacgaugucuucacaguuucuugucgaguucucacgagaccaucccccgauuuugauuuuauauucuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacugucuccugucaacaucugcaccuucagaggggaugucacccauauuccaggcagucauaacuacacaaugaauuuggccucccaaaauuggaacaguuacgauccaacagaagaaaucccagccccucuaggaacuccagauuucguggggaagauucaaggugugcucacucagaccacaaguacaaauggcucgacccgcggccacaaagcuacaguguacacugggagcgccgacuuuucuccaaaacuggguagaguucaauuugccacugacacaaacaaugauuuugaaacuaaccaaaacacaaaauucaccccagucggcguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggaccuggauugucugcucccccaggaaugggugcaguacuucuaccaggaggcagccccagcacaaucugauguggcccuguuaagauuugugaauccagauacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 7970 - RNA, 1617 nt, Artificial Sequence
  VP1__Norovirus_and/or_Norovirus-like__LC153122
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaauaauuuuguacaagccccugguggggaguucacaguauccccuagaaacgcuccaggugaaauacuauggagcgcgccccuaggcccugaccuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaaguccuagccaggucacuauguucccccauauaauaguggauguuagacaauuagaaccugugcugauucccuuacccgaugucaggaauaauuucuaucauuacaaucagucaaaugauuccacuauuaaguugauagcaauguuguauacaccacuuagggcuaauaaugcuggggaugauguuuucacagucucgugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacaacugauggcgugcuucuaggcaccacccaacugucuccugucaacaucugcaccuucagaggggaugucacccacaucacagguagucgcaacuacacaaugaauuugguuucucaaaauuggaacaacuaugacccaacagaagaaaucccagcaccucuaggaacuccagauuuuguggggaagauccaaggcaugcucacccaaaccacaaggacagaugguucaacacgcggccacaaagcuacaguguacacugggagcgccgacuuugcuccaaaacuggguagaguucaauuugaaacugacacagaccaugauuuugaagcuaaucaaaacacaaaguucaccccagucggugucauccaagaugguagcaccacccaccgaaacgaaccccaacagugggugcucccaaguuacucaggcagaaauacucacaauguacaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuuguaaauccagacacagguaggguuuuguuugagugcaagcuucacaaaucaggcuauguuacaguggcucacacuggccaacaugauuugguuaucccccccaaugguuacuuuagguuugauuccugggucaaccaguucuacacgcuugcccccaugggaaauggaacggggcguagacguuaa

SEQ ID NO: 7971 - RNA, 1617 nt, Artificial Sequence
  VP1__Norovirus_and/or_Norovirus-like__KR131777
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuaccugauguuaggaauaauuucuaccauuauaaucaaucaaaugaccccaccaucaaauugauagcaauguuguacacaccacuuagggcuaauaaugccggggacgaugucuucacaguuucuugucgaguucuuacgagaccaucccccgauuuugauuucauauuuuuggugccacccacaguugaaucaagaacuaaaccauucucugucccaguuuuaacuguugaggagaugaccaauucaagguuccccauuccuuuggagaaguuguucacgggccccaguagugccuuuguuguucaaccacaaaauggcaggugcacgacugauggcgugcuccuagguacuacccaacuguccccugucaacaucugcaccuucagaggggaugucacccauauuccgggcagucguaacuacacaaugaauuuggccucccaaaauuggagcaguuacgauccaacagaagaaaucccagccccucuaggaacuccagauuucguggggaagauucaaggugugcucacccaaaccacaaggacaaauggaucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccucaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggagugggugcaguacuucuaccaggaggcagcuccagcacaaucugauguggcucugcuaagauuugugaauccagacacagguaggguuuuguuugaguguaaacuucacaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7972 - RNA, 1617 nt, Artificial Sequence
  VP1__Norovirus_and/or_Norovirus-like__AB933764
augaagauggcgucgagugacgccaacccaucugauggguccacagccaaccucgucccagagguuaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaauuaaaugaccccaccaucaaauugauagcaauguuguacacaccacuuagggcuaauaaugccggggaugaugucuucacaguuucuugucgaguucuuacgagaccaucccccgauuuugauuucauauuuuuggugccacccacaguugaaucaagaacuaaaccauucucuguuccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacuggaagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcuaccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaauguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7973 - RNA, 1617 nt, Artificial Sequence
  VP1__Norovirus_and/or_Norovirus-like__LC016600
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucccaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuccaggcacuaguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucgccacugauacagacaaugauuuugaaacuggccaaaacacaagguucaccccagucggugucauccaggaugguaguggugcccacagaaaugaaccccaacaauggguacucccaaauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacguuaa

SEQ ID NO: 7974 - RNA, 1617 nt, Artificial Sequence
  VP1__Norovirus_and/or_Norovirus-like__KJ433970
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucuguuccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccacaucacagguagucguaacuacacaaugaauuuggcuucucaaaauuggagcaauuaugacccaacagaagaaaucccagccccccuaggaacuccagauuuuguggggaagauucaaggcgugcucacccaaaccacaaggacagauggcucaacacgcggccacaaagccacaguguacacugggagcgccgacuuugcuccaaaacuagguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucacgcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7975 - RNA, 1617 nt, Artificial Sequence
  VP1__Norovirus_and/or_Norovirus-like__KP176395
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuucccaacugaaggcuugagccccagccaggucacuauguucccccauauaguaguagauguuaggcaacuagaaccuguguugauucccuuacccgauguuaggaauaacuucuaucauuacaaucaaucaaaugaccccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuugucguccaaccacaaaacgguaggugcacgacugauggcgugcuccuaggcaccacccaacugucuccagucaacaucugcaccuucagaggagaugucacccacaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccauaaagccacaguguacacugggagcgucgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7976 - RNA, 1617 nt, Artificial Sequence
  VP1__Norovirus_and/or_Norovirus-like__KM982947
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcaaguaauucucgcggggaacgcguucaccgccgggaaagucauauuugcagcagucccaccaaauuuuccaacugaaggcuugagccccagccaggucacuauguucccccauauagcaguagauguuaggcaauuagaaccuguguugauucccuuacccgacguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguacacugggagcgcugacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugccugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7977 - RNA, 1617 nt, Artificial Sequence
  VP1__Norovirus_and/or_Norovirus-like__KJ685414
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaaugcguucaccgcggggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaagugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccagaccacaaggacaaauggcucgacccgcggccacaaagcuacaguguacacugggagcgccgacuuuucuccaaaacuggguagaguucaauuugccacugacacagacaaugauuuugaaacuaaucaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuucagauuugauuccugggucaaccaguucuacacacuugcccccaugggaaaugggacggggcguagacguuaa

SEQ ID NO: 7978 - RNA, 1617 nt, Artificial Sequence
  VP1__Norovirus_and/or_Norovirus-like__KF060093
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuucccauuccuuuggaaaaguuguucacgggccccaguagugccuucguuguucaaccacaaaacggcaggugcacgacugauggcgugcuccuagguaccacccaacugucuccugucaacaucugcaccuucagaggggaugucacccacauuucaggcagucguaacuacacaaugaauuuggccucccaaaauuggaacaguuacgacccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaacacuaccccccgaaaugaaccccaacaaugggugcucccaaguuacucagguagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguucuguuugaguguaagcuucauaaaccagguuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7979 - RNA, 1617 nt, Artificial Sequence
  VP1__Norovirus_and/or_Norovirus-like__KC456070
augaagauggcgucaagugacgccaacccaucugauggguccgcagcuaaccucgucccaaaggucaacaaugagguuauggcucuggagcccguuguuggugccgccauugcggcaccuguagcgggccaacaaaauguaauugaccccuggauuaaaaauaauuuuguacaagccccugguggagaguuuacaguauccccuaaaaacgcuccaggugaaauacuauggagcgcgcccuugggcccugaucuaaaucccuaccuaucccauuuggccaaaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggggaugucacccacaccauagguagucguaacuacacaaugaauuuggcuucucaaaauuggaacaauuaugacccaacagaagaaaucccagccccucuaggaacuccagauuuuguggggaagauucaaggcguacucacccaaaccacaaggacagauggcucaacacgcggccacaaagcuacaguguacacugggagcgccgacuuugcuccaaaacuggguagaguucaauuugaaacugauacagaccaugauuuugaagcuaaccaaaacacaaaguucaccccaguuggugucauccaagaugguagcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaggaggcagccccagcacaaucugauguggcucugcuaagauuugugaauccagacacaggaaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgguaa

SEQ ID NO: 7980 - RNA, 1617 nt, Artificial Sequence
  VP1__Norovirus_and/or_Norovirus-like__KC409299
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggaaaugaccaauucaagguuccccauuccuuuggagaaguuguucacgggccccaguaaugccuuuguuguucaaccacaaaacggcaggugcacgaccgauggcgugcuccuagguacuacccaacugucucccgucaacaucugcaccuucagaggggacgucacccauauuccaggcagucguaacuacacaaugaauuuggccucccaaaauuggaacaguuacgacccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuauucagguagagauguucauaaugugcaccuggccccugcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7981 - RNA, 1617 nt, Artificial Sequence
  VP1__Norovirus_and/or_Norovirus-like__JX984947
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagccaggucaccauguucccccauauaauaguggauguuaggcaauuggaaccuguguugauccccuuaccugauguuaggaauaauuucuaucacuauaaucagucaaaugauucuacuauuaaauugauagcaaugcuuuauacaccacuuagggcuaauaaugcuggggaagaugucuuuacaguuucuugccgaguucucacgaggccauccucugauuuugauuucauauuuuuggugccaccuacaguugagucaagaacuaagccauuuacugucccaaucuuaacuguugaagaaaugaccaacucaagguuccccauuccuuuggagaaguuguucacgggucccagcagugccuuuguuguucaaccacaaaauggcagaugcacaacugauggcgugcucuuaggcaccacccagcugucuccugucaacaccugcaccuucagaggggaugucacccacauugcagguucucguaauuacacaaugaauuuggcuucucuaaauuggaacaauuaugacccaacagaagaaauuccagccccucuagggacuccagauuucgugggaaagauccaaggugugcucacucaaaccacaaagggagauggcucgacccguggccauaaagcuacaauuuacacugggagugcccccuucacuccaaagcugggcaguguccaauucaauacugacacagaaaaugauuuugaaacccaccaaaacacaaaauucaccccagucggugucauccaggaugguggcaccacccaccgaaaugaaccucaacaaugggugcucccgaguuauucagguagaaauaucccuaauguacaccuagccccugcuguagcccccacuuucccgggugaacaacuucuuuucuuuagguccacuaugcccggaugcagcggguaucccaacauggauuuggacugccuacuaccccaggagugggugcagcacuucuaccaagaggcagcuccagcacaaucugauguggcucuauugagauuugugaauccagacacggguaggguccuguuugagugcaaacuucacaaaucaggcuaugucacaguggcucacaccggccagcaugauuuggucaucccccccaaugguuauuuuagguuugauuccuggguuaaucaauucuacacgcuugcccccaugggaaauggaacggggcguagacguuaa

SEQ ID NO: 7982 - RNA, 1617 nt, Artificial Sequence
  VP1__Norovirus_and/or_Norovirus-like__KC175385
augaagauggcgucgagugacgccaacccaucuaauggguccacagccaaccuugucccagagguuaauaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuccaagcagucauaacuacacaaugaauuuggccucccaaaauuggaacaguuacgauccaacagaagaaaucccagccccucuaggaacuccagauuucguggggaagauucaaggugugcucacccaaaccacaaggacagauggcucgacccgcggccacaaagcuacaguguacacugggagcgccgacuuuucuccaaaacuggguagaguucaauuugccacugacacagacaaugauuuccaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7983 - RNA, 1617 nt, Artificial Sequence
  VP1__Norovirus_and/or_Norovirus-like__JQ613563
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacaugauaguagauguuaggcaauuggaaccuguguugauccccuuacccgauguuaggaauaauuucuaccacuauaaucaaucaaaugaccccaccaucaaauugauagcaauguuguacacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguuuacgggccccaguagugccuuuguuguucaaccacaaaacggcaggugcacgacugauggcgugcuccuagguacuacccaacuguccccugucaacaucugcaccuucagaggggaugucacccauacuccaggcagucauaacuacacaaugaauuuggccucccaaaauuggaacaguuacgauccaacagaagaaaucccagccccucuaggaacuccagauuucguggggaagauucaaggugugcucacccaaacaacaaggacaaauggcucgacucgcggccacaaagcuacaguguacacugggagcgccgacuuuucuccaaaacuggguagaguucaauuugccacugacacagacaaugauuuugaaacuaaccaaaacacaaaguuuaccccagucgguguuauccaggaugguaguacuaccccccgaaaugaaccccaacaaugggugcucccaaguuacucaggcagaaacauucauaaugugcaccuggcccccgcuguggcccccacuuucccgggcgagcagcuccucuucuucagaucuacuaugcccggaugcagcggguaccccaacauggauuuggacugccugcucccccaggaaugggugcaguacuucuaccaggaggcagccccagcacaaucugacguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7984 - RNA, 1617 nt, Artificial Sequence
  VP1__Norovirus_and/or_Norovirus-like__JQ613558
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuuccugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacaggccccaguagugccuuuguuguucaaccacaaaacggcaggugcacgaccgauggcgugcuccuagguacuacccaacugucuccugucaacaucugcaccuucagaggggaugucacccauauuccaggcagucguaacuacacaaugaauuuggccucccaaaauuggaacaguuacgacccaacagaagaaaucccagccccucuaggaacuccagauuucguggggaagauucaaggugugcucacccaaacuacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauccauaaugugcaccuggcccccgcuguagcccccacuuucccgggcgaacagcuccucuucuucagaucuaccaugcccggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuccauaaaucaggcuauguuacaguggcucacauuggccaguaugauuugguuaucccccccaaugguuauuuuagauuugauuccugggucaaccaguucuacacacuugcccccaugggaaaugggacggggcguagacguuaa

SEQ ID NO: 7985 - RNA, 1617 nt, Artificial Sequence
  VP1__Norovirus_and/or_Norovirus-like__GQ856451
augaagauggcgucgaaugacgccaacccaucugauggguccguagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaccugaaucccuaccuaucucauuuggcuagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccauaugauaguggauguuaggcaauuggaaccuguguugauccccuuaccugauguuaggaauaacuucuaucacuauaaucagucaaaugauucuacuauuaaauugauagcaaugcuguauacaccacuuagggcugauaaugcuggggaagaugucuucacagucucuugucgaguucucacgaggccauccccugauuuugauuuuauauuuuuggugccaccuacaguugagucaaaaacuaaaccauuuacugucccaaucuuaacuguugaagaaaugaccaauucaagauuccccauucccuuggaaaaauuguucacgggucccagcaguaccuuuguuguucaaccacaaaauggcagaugcacgacugauggcgugcucuuaggcaccacccaacugucuccugucaacaucugcaccuucagaggggaugucacccacauugcagguucucguaacuauacaaugaauuuggcuucucuaaauuggaacaauuaugacccaacagaagaaauuccagccccucuaggaacuccagauuucgugggaaagauccaaggugugcuuacucaaaccacaaagggagacgguucgacccguggccauaaagcuacaguuuacacugggagugcccccuuuacuccaaagcugggcaguguucaauucaguacugauacagaaaaugauuuugaaacucaccaaaauacaaaauucaccccagucggugucauccaggaugguagcaccacccaccgaaaugaaccccaacaaugggugcucccaaguuauucagguagaaauguccauaauguacacuuagccccugcuguagcccccacuuuuccgggugaacaacuucucuucuuuagguccacuaugcccggaugcagcggguaucccaacauggauuuggauugccuacucccccaggagugggugcagcauuucuaccaagaggcagcuccagcacaaucugauguggcucuauugagauuugugaauccagacacggguaggguccuguuugaaugcaaacuucauaaaucaggcuaugucacaguggcucacaccggccagcaugauuuggucaucccccccaaugguuauucuagguuugauuccuggguuaaucaauucuacacacuugcccccaugggaaauggaacggggcguagacguuaa

SEQ ID NO: 7986 - RNA, 1617 nt, Artificial Sequence
  VP1__Norovirus_and/or_Norovirus-like__DQ419908
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuccagguacucguacuuacagaaugaauuuggcuucucaaaauuggaacaauuaugacccaacagaagaaaucccagccccucugggaacuccagauuucgugggaaagauccaaggcaugcucacccaaaccacgaagggagacggcucgacccgcggucacaaagccacagugagcacugggaguguugacuuuacuccaaagcuggacagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucacaaugugcaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagccccaucacaaucugauguggcuuugcugagauuugugaauccagacacagguaggguccuguuugagugcaagcuucauaaagcaggcuaugucacaguggcucacacuggccagcaugauuugguuaucccccccaauggcuacuuuagauuugauuccugggucaaccaguucuacacacuugcccccaugggaaauggagcggggcguagacguuaa

SEQ ID NO: 7987 - RNA, 1617 nt, Artificial Sequence
  VP1__Norovirus_and/or_Norovirus-like__KX514354
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauucccuuaccugauguuaggaauaacuucuaccauuauaaucagucaaaugauucuaccauuaaauugauagcaaugcuguauacaccacuuagggccaauaaugcuggggaugaugucuucacagugucuugucgaguccucacgaggccauccccugauuuugauuucauauuccuggugccacccacaguugagucaagaucuaagcccuuuucugucccagucuuaacuguucaagaaaugaccaauucaagauuccccgcuacuuuggauaaauuguucacaggucccagcaguacccuuguuguucaaccacaaaauggcagaugcaugauugauggcgugcucuuaggcaccacccaacuguccccugucaacauuugcaccuucagaggggaugucacccacucuagggacuccacaauuuacacaaugaauuuggccuccccaaauuggaacaauuaugacccaacagaagagauuccagccccucugggaacuccagauuuugugggaaagauucaaggugugcucacucaaaccacaaagggagaagguucgacccggggccauagagcuacaguuuauguugggagugccaacuacacuccaaagcugggcaaaguucaauuugagacuaacacaacuaaugaucuuuaugcucaccaaaacacaagauucaccccagucggugucguccaggguggugaguccgcccaccgaagugaaccccaacaaugggugcucccaaguuauucagguagagacaccccuaauguacaucuagccccugcuguagcccccacuuucccaggugagcaacuucuuuucuucagauccacuauacccggaugcggcgggcaucccaacauggauuuggauugccuacucccccaggagugggugcaacacuucuaccaagaggcagcuccagcacaaucugauguggcucuauugagauuugugaauccagacacaaguaggguccuguuugagugcaaacuucauaaaucagguuaugucacaguggcucacaccggucaacaugauuugguuaucccccccaauggcuacuuuagauuugauuccugggucaaucaauucuacacacuugcccccaugggaaauggaacggggcguaagcguuaa

SEQ ID NO: 7988 - RNA, 1617 nt, Artificial Sequence
  VP1__Norovirus_and/or_Norovirus-like__KX354062
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggcuagaauguacaaugguuaugcaggugguuuugaagugcaggugauccucgcggggaacgcguucaccgccgggaaaaucauauuugcagcagucccaccaaauuucccaacugaagguuugagccccagccaggucacuauguucccacacauaauaguagauguuaggcaauuggaaccuguguugauccccuuacccgauguuaggaauaauuucuaucauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaauuuuaacuguugaggagaugaccaauucaagguuccccauucccuuggaaaaguuguucacgggccccaguagugccuuuguuguucaaccacaaaacggcaggugcacgacugauggcgugcuccuagguaccacucaacugucuccugucaacaucugcaccuucagaggggaugucacccauauuccaaacagucauaacuacacaaugaauuuggccucccaaaauuggaacaguuacgacccaacagaagaaaucccagccccucuaggaaccccagauuucguggggaagauucaaggugugcucacucaaaccacuaguacaaauggcucgacccgcggccacaaagcuacaguguacacugggagcgccgacuuuucuccaaaacuggguagaguucaauuugccacugacacaaacaaugauuuugaaacuaaccaaaacacaaaauucaccccagucggcguuauccaggaugguaguaccaccccccgaaaugaaccccaacaaugggugcucccaaguuacucagguagaaacauucacaaugugcaccuggcccccgcuguagcccccacuuucccgggcgagcagcuccucuucuucagaucuacuaugcccggaugcagcggguaccccaacauggaccuagauugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 7989 - RNA, 1617 nt, Artificial Sequence
  VP1__Norovirus_and/or_Norovirus-like__AB972532
augaagauggcgucgagugacgccaacccaucugauggguccgcagccaaccucgucccagaggucaacaaugaggucauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccaccuacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacuaucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7990 - RNA, 1617 nt, Artificial Sequence
  VP1__Norovirus_and/or_Norovirus-like__KT202796
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgacguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguacacugggagcgcugacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcuuccaaguuacucaggcagaaauacuccuaaugugcauuuggcccccgcuguagcccccacuuuuccgggugagcaacuucuuuuuuucagauccaccaugcccggaugcagcggguaccccaacauggacuuggacugccugcucccccaggaaugggugcaguacuucuaccaagacgcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagacguuaa

SEQ ID NO: 7991 - RNA, 1617 nt, Artificial Sequence
  VP1__Norovirus_and/or_Norovirus-like__AB933751
augaagauggcgucuagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccgacugaagguuugagucccagccaggucacuauguucccccacauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuucuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaagguguacucacccaaaccacaaggacaaauggcucgacccgcggccacaaagcuacaguguacacugggagcgccgacuuuucuccaaaacuggguagaguucaauuugccacugacacagacaaugauuuugaaaauaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugacguggcucuguuaagauuugugaauccagacacagguaggguuuuguuugaguguaagcuucauaaaucaggcuauguuacaguggcucacacuggccagcaugaucugguuaucccccccaaugguuauuuuagauuugauuccugggucaaccaguucuacacacuugcccccaugggaaaugggacggggcguagacguuaa

SEQ ID NO: 7992 - RNA, 1617 nt, Artificial Sequence
  VP1__Norovirus_and/or_Norovirus-like__KM514078
augaagauggcgucgagugacgccaacccaucugauggguccgcagccaaccucgucccagaggucaacaaugagguuuuggcucuggagcccguuguaggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuccuagugccacccacaguugagucaagaacuaaaccauucucugucccaguuuuaacuguugaggagaugaccaauucaagguuccccauuccuuuggaaaaguuguucacgggucccagcagugccuuuguuguccaaccacaaaacgguaggugcacgacugacggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaccuggccccugcuguagcccccacuuuuccgggugagcaacuucucuucuucagauccaccaugcccggaugcagcggguaccccaacauggauuuggacugucuacucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 7993 - RNA, 1617 nt, Artificial Sequence
  VP1__Norovirus_and/or_Norovirus-like__KM198569
augaagauggcgucgaaugacgccaacccaucugauggguccgcagccaaccucgucccagaggucagcaaugagguuauggcuuuggagcccguugccggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaauuucuaucauuauaaucagacaaaugauucuaccauuaaauuaauagcaaugcuguacacaccacuuagggccaauaacgcuggggaagaugucuucacagucucuugucgaguccucacuaggccguccccugauuuugauuuuauauuuuuggugccacccacaguugagucaagaacuaaaccauuuacugucccaaucuuaaccguugaagaaaugaccaauucaagauuccccauuccuuuggaaaaguuguucacgggucccagcggugcuuuuguuguccaaccacaaaauggcaggugcacgacugauggcgugcucuuaggcaccacccaacugucucccgucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaaaggagauggcucgacccguggccauaaagcuacaguuuacacugggagugcccccuuuacuccaaagcugggcaguguucaauucaguacugacacagagaaugauuuugaaacucaccaaaacacaaaauucaccccagucggugucauccaggaugguggcaccacccaccgaaaugaaccccaacaaugggugcucccaaguuauucagguagagauguucauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggucagcaugauuuggucaucccccccaauggcuauuuuagguuugauuccuggguuaaucaguucuacacgcuugcccccaugggaaacggaacggggcguaggcgcuaa

SEQ ID NO: 7994 - RNA, 1617 nt, Artificial Sequence
  VP1__Norovirus_and/or_Norovirus-like__KF768522
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugaucugaaucccuaccuuucucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugaucccuuuacccgauguuaggaauaauuucuaccauuauaaucaaucaaacgaccccacuaucaaauugauagcaaugcuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucauccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccucaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguugagauuugugaauccagacacagguaggguuuuguuugaguguaagcuccauaaaucgggcuauguuacaguggcucacacuggccaacaugauuugguuauuccccccaaugguuauuuuagauuugauuccugggucaaccaguucuacacacuugcccccaugggaaaugggacggggcguagacguuaa

SEQ ID NO: 7995 - RNA, 1617 nt, Artificial Sequence
  VP1__Norovirus_and/or_Norovirus-like__KF060120
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuugugcaagccccugguggagaguuuacaguauccccuagaaacgcuccaggugaaauacuauggaacgcgcccuuaggcccugauuugaaucccuaccuuucccauuuggccagaauguacaaugguuaugcagguggcuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaagugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagauccacuaugcccggaugcagcggguaccccaacauggauuuggacugucugcucccccaggaaugggugcaguauuucuaccaagaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 7996 - RNA, 1617 nt, Artificial Sequence
  VP1__Norovirus_and/or_Norovirus-like__KF060102
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgccuuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacaagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggaaaugucacccauaucacagguagucguaacuacacaaugaauuuggcuucucaaaauuggaacaauuaugacccaacagaagaaauuccagccccucuaggaacuccagauuuuguggggaagauucaaggcgugcucacccaaaccacaaggacagauggcucaacacgcggccacaaagccacaguguacauugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaacacucauaaugugcaucuggcucccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcccacacuggccaacaugauuugguuaucccccccaaugguuauuuuagguuugauuccugggucaaccaguuuuacacgcuugcccccaugggaaauggaacggggcguagacguuaa

SEQ ID NO: 7997 - RNA, 1617 nt, Artificial Sequence
  VP1__Norovirus_and/or_Norovirus-like__KF060088
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaaugcguucaccgccggaaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggaaaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaauaguuaugauccaacagaagaaaucccagccccccuaggaacuccagauuucguggggaagauucaagguaugcucacccaaaccacaaggacagacggcucgacccgcggccacaaagcuacaguguacacugggagcgccgacuuuucuccaaaacuggguaggguucaauuugccacugacacagacaaugauuuuguaacuaaccaaaacacaaaguucaccccagucgguguuauccaggaugguaguacuaccccccgaaaugaaccccaacaaugggugcucccaagcuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 7998 - RNA, 1617 nt, Artificial Sequence
  VP1__Norovirus_and/or_Norovirus-like__KF060025
augaagauggcgucgagugacgccaacccaucugauggguccacagccaaccucgucccagaggucaauaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugauuugaaucccuaccuuucccauuuggccagaauguacaaugguuacgcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguacugauccccuuacccgauguuaggaauaauuucuaccauuauaaccagucaaaugaccccaccaucaaauugauagcaauguuguauacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacucaacuaucuccugucaacaucuguaccuucagaggggaugucacccacauuucaggcagucguaacuacacaaugaauuuggccucccaaaauuggaacaguuacgauccaacagaagaaaucccagccccccuaggaacuccagauuucguggggaagauccaaggugugcucacccaaaccacaagaacagauggcucgacccgcggccacaaagcuacaguguacacugggagcgccgacuuuucuccaaaacuggguaggguucaauucgccacugacacagacaaugauuuuguagcugaccaaaacacaaaguucaccccagucgguguuauccaggaugguagcacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagguuugugaauccagacacagguaggguuuuguuugagugcaagcuucauaaaucaggcuauguuacaguggcucacacuggccaacaugauuuaguuaucccccccaauggcuauuuuagauuugauuccugggucaaccaguucuacacacuugcccccaugggaaaugggacggggcguagacguuaa

SEQ ID NO: 7999 - RNA, 1617 nt, Artificial Sequence
  VP1__Norovirus_and/or_Norovirus-like__KC517378
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuggaaccuguguugauucccuuacccgauguugggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggagaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguacaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 8000 - RNA, 1617 nt, Artificial Sequence
  VP1__Norovirus_and/or_Norovirus-like__JX459640
augaagauggcgucgagugacgccaacccaucugauggguccacagcccaccuugucccagaggucaacaaugagguuauggcuuuggagcccguaguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcaaguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguagaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8001 - RNA, 1617 nt, Artificial Sequence
  VP1__Norovirus_and/or_Norovirus-like__JQ613512
augaagauggcgucgagugacgccaacccaucugauggguccacagccaaccucgucccagaggucaacaaugagguuauggcuuuggagcccguuguuggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcagguggcuuugaagugcaggugauccucgcggggaacgcguucaccgccggaaaaauuauauuugcagcagucccaccaaauuuuccaacugaaggccugagucccagccaggucacuauguucccccacauaauaguagauguuaggcaauuggaaccuguguugauccccuuaccugauguuaggaauaacuucuaucacuauaaucagucaaaugauucuaccauuaaauugauagcaaugcuguacacaccacuuagggccaauaaugcuggggaagaugucuucacagucucuugucgaguccucacgaggccguccccugauuuugauuuuauauuuuuggugccacccacaguugagucaagaacuaaaccauuuacugucccaaucuuaacuguugaagaaaugaccaauucaagauuccccauuccuuuggaaaaguuguucacgggucccagcggugccuuuguuguccaaccacaaaacggcaggugcacgacugauggcgugcucuuaggcaccacccaacugucuccugucaacaucugcaccuucagaggggaugucacccacauugcagguucucguaauuacacaaugaauuuggcaucucuaaauuggaacaauuaugacccaacagaagaaauuccagccccucugggaacuccagauuucgugggaaagauccaaggugugcucacucaaaccacaaagggagauggcucgacccguggccacaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaauauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugauuuggucaucccccccaauggcuauuuuagguuugaugccuggguaaaucaauucuacacacuugcccccaugggaaauggaacggggcguaaacguuaa

SEQ ID NO: 8002 - RNA, 1617 nt, Artificial Sequence
  VP1__Norovirus_and/or_Norovirus-like__HQ005299
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuguccagaauguacaaugguuaugcaggugguuuugaagugcagguaauccucgcggggaaugcguucaccgccgggaaaaucauauuugcagcagucccaccaaauuucccaacugaagguuugagccccagccaggucacuauguucccccacauaauaguagaugucaggcaauuggaaccuguguugauucccuuacccgauguuagaaauaauuucuaccauuauaaucaaucaaaugaccccaccaucaaauugauagcaauguuguacacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauccaaggugugcucacccaaaccacaaggacaaauggcucgacccguggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuauucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucuguuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8003 - RNA, 1617 nt, Artificial Sequence
  VP1__Norovirus_and/or_Norovirus-like__AB541312
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuucguacaagccccugguggagaguucacaguauccccuagaaacgcuccaggugaaauacuguggagcgcgcccuuagguccugauuugaaucccuaccuuucccauuuggccagaauguacaaugguuaugcaggugguuuugaagugcaggugauccucgcggggaacgcguucaccgccggaaagaucauauuugcagcagucccaccaaauuucccaacugaaggcuugagccccagccaggucacuauguucccccacauaauaguagauguuaggcaauuggaaccuguguugaucccccuacccgauguuaggaauaauuucuaucacuacaaccaaucaaaugaccccaccaucaaauugauagcaauguuguauacaccacuuagggccaauaaugcuggggacgaugucuucacaguuucuugucggguucucacgagaccaucccccgauuuugauugcauauuagaccuaccacccacaguugagucaagaacuaaaccauucucugucccaauuuuaacuguugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuauuccccccaaugguuauuuuagauuugauuccugggucaaccaguucuacacacuugcccccaugggaaauggaacggggcguagacguuaa

SEQ ID NO: 8004 - RNA, 1617 nt, Artificial Sequence
  VP1__Norovirus_and/or_Norovirus-like__AB541275
augaagauggcgucgagugacgccaacccaccugauggguccgcagccaaccucgucccagaggucaacaaugagguuauggcuuuggagcccguugucggugccgcuauugcggcgccuguggcgggccaacaaaauguaauugaccccuggauuagaaauaauuuugugcaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugaaggcuugagucccagccaggucacuauguucccccacauaauaguagauguuaggcaauuggaaccuguguuaauccccuuaccugauguuaggaauaauuucuaucacuauaaccagucaaaugauucuaccauuaaauugauagcaaugcuguauacaccacuuagggcuaauaaugcuggggaagaugucuucacagucucuugucgaguccucacgaggccauccccugauuuugauuuuauauucuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguagcuacacaaugaauuuggcuucucuaaauuggaacaauuaugacccaacagaagaaauuccagccccucuaggaacuccagauuucgugggaaagauccaagguaugcucacucaaaccacaaagggagauggcucgacccguggccauaaagcuacaguuuacacugggagugcccccuuuacuccaaagcugggcaguguucaauucaguacugauacagaaaaugauuuucaaacucaccaaaacacaaaauucaccccagucggugucauccaggaugguagcaccacccaccgaaaugaaccccaacaaugggugcucccaaguuauucagguagagauguccauaauguacaccuagccccugcuguagcccccacuuucccgggugaacaacuucuuuucuucagguccacuaugcccggaugcagcggguaucccaacauggauuuggauugccuacucccccaggagugggugcagcacuucuaccaagaggcggcuccagcacaaucugauguggcucuauugagauuugugaauccagacacggguaggguccuguuugagugcaaacuucauaaaucaggcuaugucacaguggcucacaccggccagcaugauuuggucaucccccccaauggcuacuuuagguuugauuccuggguuaaucaauucuacacacuugcccccaugggaaauggaacggggcguagacguuaa

SEQ ID NO: 8005 - RNA, 1617 nt, Artificial Sequence
  VP1__Norovirus_and/or_Norovirus-like__AB303930
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaauggcuaugcagguggcuuugaagugcagguaguccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccagauguuaggaacaaucuuuaucauuauaaucaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaaccaaaccauucaccgucccaauuuuaacuggugaggaaaugaccaauucaagauuccccauuccuuuggaaaaguuguucacggguccuagcggugccuuuguuguucaaccacaaaauggcaggugcacgacugauggcgugcucuuaggcaccacucagcuguugccugucaacaucugcaccuucagaggggaugucacccacauugcagguacucauaauuacacaaugaauuuggcuucucagaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccucaacaaugggugcucccaagcuacucagguagaacuagucacaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacguuaa

SEQ ID NO: 8006 - RNA, 1617 nt, Artificial Sequence
  VP1__Norovirus_and/or_Norovirus-like__AY485642
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucugaaucccuaccuuccucauuuggccagaauguacaauggcuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaccaaucaaaugaccccaccauuaaauugauagcaaugcuguacacaccacuuagggcuaauaaugcuggggaagaugucuucacagucucuugucgaguccucacgaggccaucccccgauuuugauuucauauuuuuggugccacccacaguugagucaagaacuaaaccauucaccgucccaauuuuaacuguugaggaaaugaccaauucaagauuccccauucccuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcagguacucauaauuacacaaugaauuuggcuucucaaaauuggaacaauuauggcccaacagaagaaaucccagccccucuggggaccccagauuucguggggaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccccagcaaugggugcucccaagcuacucagguagaacuggucauaauguacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcaccagcacaaucugauguggcucugcuaagauuugugaauccagacacagguaggguucuauuugagugcaagcuucauaaaucaggcuaugucacaguggcucacacuggccagcaugauuugguuaucccccccaauggcuacuuuagauuugauuccugggucaaccaauucuacacacuugcccccaugggaaaugggacggggcguagacguuaa

SEQ ID NO: 8007 - RNA, 1617 nt, Artificial Sequence
  VP1__Norovirus_and/or_Norovirus-like__KX514343
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguacacaccacuuaggaccaauaaugcuggggaugaugucuucacagucuccugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccaaucugggaacacuaaaauuuacacaaugaauuuggccucuccaaauuggaacaauuaugacccaacagaagagauuccagccccucugggaacuccagauuuuguaggaaagauccaagguaugcucacucaaaccacaaagggagaagguucgacccggggccauagagcuacaguuuauguugggagugccaacuaugcuccaaagcuagguagaguucaauuugaaacugacacaacugaugaucuugaugcucaccaaaacacaaaauucaccccagucggugucguccagaguggugaaucccccaaaggaagugaaccccaacaaugggugcucccaaguuauucagguagagauacccccaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8008 - RNA, 1617 nt, Artificial Sequence
  VP1__Norovirus_and/or_Norovirus-like__KX514274
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccgggugaaauacuauggagcgcgcccuuagguccugaucugaaucccuaccuaucucauuuggcuagaauguauaaugguuaugcaggugguuuugaagugcaggugauccucgcggggaaugcguuuaccgcgggaaaaaucauauuugcagcagucccuccaaauuuuccaacugaaggcuugagucccagccaggucacuauguucccccauauaauaguagauguuaggcaauuagaaccuguguugauccccuuaccugauguuaggaacaacuucuaucauuacaaucagucaaaggauuccaccauuaaauugauagcaaugcuguauacaccacuuagggccaauaaugcuggggaugaugucuucacaguuucuugccgaguccucacgaggccauccccugauuuugacuucauauuccuggugccaccuacaguugagucaaggucuaagcccuuuucugucccagucuuaacuguugaagaaaugaccaauucaagauuccccguuacuuuagauaaauuguucacaggccccagcaguaccauuguuguucaaccacaaaauggcagaugcacgauugauggcgugcucuuaggcaccacccaacuguccccugucaacauuugcaccuucagaggggacgucacccacccuagggacucuacaauuuacacaaugaauuuggccucuccaaauuggaacacuuaugacccaacagaagaaauuccagccccucugggaacuccagauuuugugggaaagauccaagguaugcucacucaaaccacaaagggagcaggaucgacccggggccauagagcuacaguuuauguugggagugccaacuaugccccaaagcuggguagaguucaauuugaaacuaacacaagugaugaucuugaugcucaccaaaacacaaaauucaccccagucggugucauccaggguggugaauccgcccaccgaagugaaccccaacaaugggugcucccaaguuauucagguagagauaucccuaauguacaucuagccccugcuguagcccccacuuucccgggugaacaacuucucuucuucagauccacuauacccgggugcggcgggcaucccaacauggauuuggauugccuacucccccaggagugggugcagcacuucuaccaagaggcagcuccagcacaaucugauguggcucuauugagauuugugaacccagacacaaguaggguccuguuugaaugcaaacuucauaaaucagguuaugucacaguggcucacaccggccaacaugauuugguuaucccccccaauggcuacuuuagauuugauuccuggguuaaucaauucuacacacuugcccccaugggaaauggaacggggcguaagcguuaa

SEQ ID NO: 8009 - RNA, 1617 nt, Artificial Sequence
  VP1__Norovirus_and/or_Norovirus-like__KX514175
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuggguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuaaaauuuacacaaugaauuuggccucuccaaauuggaacaauuaugacccaacagaagagaucccagccccucugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacugacacaacugaugaucuugaugcucaccaaaacacaaaauucaccccagucggugucguccaggguggugaaucccccaaaggaagugaaccccaacaaugggugcucccaaguuauucaggugcaaauaccuuuaauguacaccuagccccugcuguagcccccaauuuccccggugaacagcuucuuuucuucagguccacucugcccggauguggugggcaccccaacauggacuuagauugccugcucccccaggagugggugcagcacuucuaccaagaggcagcuccagcacaaucugauguggcucuauugagauuugugaauccagacacgaguaggguccuguuugagugcaaacuucauaaaucagguuaugucacaguggcucacaccggucaacaugauuuggucaucccucccaauggcuacuuuagguuugauuccuggguuaaucaauucuacacacuugcccccaugggaaauggaacggggcguaagcguuaa

SEQ ID NO: 8010 - RNA, 1617 nt, Artificial Sequence
  VP1__Norovirus_and/or_Norovirus-like__KX354093
augaagauggcgucgagugacgccaacccaucugauggguccacagccaaccucgucccagaggucaacaaugagguuauggcuuuggagcccgugguuggcgccgccauugcggcaccuguagcgggccaacaaaauguaauugaccccuggauuagaaacaauuuugugcaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgcugggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaucauuauaaucaaucaaaugauuccaccaucaaauugauagcaauguuguacacaccacuuagggcuaauaaugccggggacgaugucuucacaguuucuugucgaguucuuacgagaccaucccccgauuuugauuucauauuuuuggugccacccacaguugaaucaagaacuaaaccauucucugucccaauuuuaacuguugaggagaugaccaacucaagguuccccauuccuuuggaaaaguuguucacgggccccaguagugccuuuguuguucaaccacaaaacggcaggugcacgacugacggcgugcuccuagguaccacucaacugucuccugucaacaucugcaccuucagaggggaugucacccauauuccaggcagucauaacuacacaaugaauuuggccucccaaaauuggagcaguuacgauccaacagaagaaaucccagccccucuaggaacuccagauuucguggggaagauucaaggugugcucacucaaaccacaagcacaaauggcucgacccgcggccacaaagcuacaguguacacugggagcgccgauuuuucuccaaaacuggguagaguucaauuugccacugacacaaauaaugauuuugaaacuaaccaaaacacaaaauucaccccagucggcguuauccaggaugguaguacuaccccccgaaaugaaccccaacaaugggugcucccaaguuacucaggcagaaacauucacaaugugcaccuggcccccgcuguagcccccacuuucccgggcgaacagcuccuauucuucagaucuacuaugcccggaugcagcggguaccccaacauggauuuggauugucugcucccccaggaaugggugcaguacuucuaccaggaggcagccccagcacaaucugauguggcucuguuaagauuugugaauccagacacagguagggucuuguuugaguguaagcuucauaaaucaggcuauguuacaguggcucauacuggccaacaugauuugguuaucccccccaauggcuauuuuagauuugauuccugggucaaccaguucuacacacuugcccccaugggaaaugggacggggcguagacguuaa

SEQ ID NO: 8011 - RNA, 1617 nt, Artificial Sequence
  VP1__Norovirus_and/or_Norovirus-like__KX354003
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguucacaguguccccuagaaacgcuccaggugaaauacuauggagcgcacccuuaggcccugauuugaaucccuaucuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaacuuuuaccauuauaaucaaucaaaugacuccaccaucaaauugauagcaaugcuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacgacugauggcgugcuccuagguaccacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucggcguuauccaggaugguaguacuaccccccgaaaugaaccccaacaaugggugcucccaaguuacucaggcagaaauacucauaaugugcaccuggcccccgcuguagcccccacuuucccgggcgagcagcuucucuucuucagaucuacuaugcccggaugcagcggguaccccaacauggacuuggacugucugcucccccaggaaugggugcaguacuucuaccaggaggcagccccagcacaaucugauguagcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8012 - RNA, 1617 nt, Artificial Sequence
  VP1__Norovirus_and/or_Norovirus-like__KR131778
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugauuugaaucccuaccuuucccauuuggccagaauguacaaugguuaugcaggugguuuugaagugcagguaauccucgcggggaaugcguucaccgcugggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucuguaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaagaacagauggcucgacccgcggccacaaagcuacaguguacacugggagcgccgacuuuucuccaaaacuggguaggguucaauuugccacugacacagacaaugauuuuguaacugaccaaaacacaaaguucaccccagucgguguuauccaggaugguagcacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagguuugugaauccagacacagguaggguuuuguuugagugcaagcuucauaaaucaggcuauguuacaguggcucacacuggccaacaugauuuaguuaucccccccaauggcuauuuuagauuugauuccugggucaaccaguucuacacacuugcccccaugggaaaugggacggggcguagacguuaa

SEQ ID NO: 8013 - RNA, 1617 nt, Artificial Sequence
  VP1__Norovirus_and/or_Norovirus-like__AB972468
augaagauggcgucgagugacgccaacccaucugauggguccgcagccaaccucgucccagaggucaacaaugaggucauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacuaucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuuguuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 8014 - RNA, 1617 nt, Artificial Sequence
  VP1__Norovirus_and/or_Norovirus-like__KR904222
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuugugcaagccccugguggagaguuuacaguauccccuagaaacgcuccaggugaaauacuauggagcgcgcccuuaggcccugaucuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacaacuagaaccugugcugauucccuuacccgaugucaggaauaauuucuaucauuacaaucaaucaaaugacuccacuauuaagcugauagcaauguuguauacaccacuuagggcuaauaaugcuggggacgaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacgacugauggcgugcuccuagguaccacccaacugucuccugucaacaucugcacuuucagaggggacgucacccacaucacagguagucguaacuacacaaugaauuuggcuucucaaaauuggaacaauugugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacugggcagaguucaauuugaaacugacacagaccaugauuuugaagcuaaccaaaacacaaaguucaccccagucggugucauccaagaugguagcaccacccaccgaaaugaaccccaacaguggguacucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuuggucaucccccccaaugguuacuuuagguuugauuccugggucaaccaguucuacacgcuugcccccaugggaaauggaacggggcguaggcgauaa

SEQ ID NO: 8015 - RNA, 1617 nt, Artificial Sequence
  VP1__Norovirus_and/or_Norovirus-like__KP244320
augaagauggcgucgagugacgccaacccaucugauggguccacagccaaccucgucccagaggucaacaaugagguuauggcuuuggagcccguaguuggugccucuauugcggcaccuguggcgggccaacaaaauguaauugaccccuggauuagaaauaauuuuguacaagccccugguggagaguuuacaguauccccuagaaacgcuccaggugaaauauuauggagcgcgcccuuaggcccugaucugaaucccuaccuuccucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguggauguuaggcaauuggagccuguguugauccccuuacccgauguuaggaauaauuucuaccauuauuaucaaucaaaugaccccaccaucaaauugauagcaauguuguacacaccacuuagggcuaauaaugcuggggacgacgucuucacaguuucuugucgaguucuuacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaacuguccccugucaacaucugcaccuucagaggggaugucacccauauuucaggcagucguaacuacacaaugaauuuggccucccaaaacuggaacaguuacgauccaacggaagagaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaucccaacaaugggugcucccaaguuacucaggaagaaacacucauaaugugcaccuggcccccgcuguagccccuacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugagugcaagcuucauaaaucaggcuauguuacaguggcucacacuggccaacaugauuugguuaucccccccaaugguuauuuuagauuugauuccugggucaaccaguuuuacacacuugcccccaugggaaaugggacggggcguagacguuaa

SEQ ID NO: 8016 - RNA, 1617 nt, Artificial Sequence
  VP1__Norovirus_and/or_Norovirus-like__KP244315
augaagauggcgucgagugacgccaacccaucugauggguccacagccaaccucgucccagaggucaacaaugagguuauggcuuuggagcccguaguuggcgccgccauugcggcaccuguagcgggccaacaaaauguaauugaccccuggauuagaagcaauuuuguacaagccccugguggagaguuuacaguauccccuagaaacgcuccaggugaaauacuauggagcgcacccuuaggcccugauuugaaucccuaccuuucccauuuggccagaauguacaaugguuaugcaggugguuuuguagugcagguaauccucgcggggaacgcguucaccgccgggaaaaucauauuugcagcagucccaccaaauuucccaacugaagguuugagccccagucaggucacuauguucccccacauaauaguagaugcuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguccucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcagaugcacgacugauggcgugcuccuagguacuacccaacugucuccugucaacaucugcaccuucagaggggaugucacccacauuucaggcagucguaacuacacaaugaauuuggcuucccaaaauuggaacaguuacgauccaacagaagaaaucccagccccucuaggaacuccagauuucguggggaagauucaaggugugcucacccaaaccacaaagacagauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacacccauaauguacaccuggcccccgcuguagcccccacuuucccgggcgagcagcuccucuucuucagaucuacuaugcccggaugcagcggguaccccaacauggaucuggacugucugcucccccaggagugggugcaguauuucuaccaggaggcagccccagcacaaucugacguggcucuguuaagauuugugaauccagauacagguaggguuuuguuugaguguaagcuucauaaaucaggcuaugucacaguggcucacaccggccaacaugauuugguuaucccccccaaugguuauuuuagauuugacuccugggucaaccaguucuacacacuugcccccaugggaaaugggacggggcguagacguuaa

SEQ ID NO: 8017 - RNA, 1617 nt, Artificial Sequence
  VP1__Norovirus_and/or_Norovirus-like__KP244314
augaagauggcgucgagugacgccaacccaucugauggguccacagccaaccucgucccagaggucaacaaugagguuauggcuuuggagcccguaguuggugccgccauugcggcaccuguggcgggccaacaaaauguaauugaccccuggauuagaaauaauuucguacaagccccugguggagaguuuacaguauccccuagaaacgcuccaggugaaauauuauggagcgcgcccuuaggcccugaucugaaucccuaccuuucucauuuggccagaauguacaaugguuacguaggugguuuugaagugcagguaauccucgcggggaacgcguucaccgccgggaaaaucauauuugcagcagucccaccaaauuucccaacugaagguuugagccccagccaggucacuauguucccccauauaauaguggauguuaggcaauuggaaccuguguugauccccuuacccgauguuaggaauaauuuccaccauuauaaucaaucaaaugaccccaccaucaaguugauagcaauguuguacacaccacuuagggcuaauaaugcuggggacgacgucuucacaguuucuugucgaguucuuacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacuguccccugucaacaucugcaccuucagaggggaugucacccauauuccaggcagucguaacuacacaaugaauuuggccucccaaaacuggaacaguuacgauccaacagaagaaaucccagccccucugggaacuccagauuucguggggaagauucaaggcgugcucacccaaaccacaaggacaaauggcucgacccgcggccacaaagcuacaguguacacugggagcgccgacuuuucuccaaaacuggguagaauucaauuugccacugacacagacaaugauuuugaaaccaaccaaaacacaaaguucaccccagucgguguuauccaggaugguaguaccaccccccgaaaugaaccccaacaaugggugcucccaaguuacucaggcagaaacacucauaaugugcaccuggcccccgcuguagcccccacuuucccgggcgagcagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugagugcaagcuucauaaaucaggcuauguuacaguggcucacacuggccaacaugauuugguuaucccccccaaugguuauuuuagauuugauuccugggucaaccaguuuuacacacuugcccccaugggaaaugggacggggcguagacguuaa

SEQ ID NO: 8018 - RNA, 1617 nt, Artificial Sequence
  VP1__Norovirus_and/or_Norovirus-like__KM268078
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggcuagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcacuuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguauuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 8019 - RNA, 1617 nt, Artificial Sequence
  VP1__Norovirus_and/or_Norovirus-like__KM198555
augaagauggcgucgagugacgccaacccaucugauggguccacagccagccuugucccagaggucaacaaugagguuauggcuuuggagcccguaguuggugccgccauugcggcacccguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaguccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuaccugauguuaggaauaauuucuaccauuauaaucaaucaaaugaccccaccaucaaauugauagcaauguuguauacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuucaggcagucguaacuacacaaugaauuuggccucccaaaguuggaacaguuacgauccaacagaagaaaucccagccccucuaggaucuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggauuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuucagauuugauuccugggucaaccaguucuacacacuugcccccaugggaaaugggacggggcguagacguuaa

SEQ ID NO: 8020 - RNA, 1617 nt, Artificial Sequence
  VP1__Norovirus_and/or_Norovirus-like__KF060115
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguaucuccuagaaacgcuccaggugaaauacuauggagcgcgcccuuaggcccugauuugaaucccuaccuuucccauuuggccagaauguacaaugguuaugcagguggcuuugaagugcagguaauccucgcggggaacgcguucaccgccgggaaaaucauauuugcagcagucccaccaaauuucccaacugaagguuugagccccagccaggucacuauguucccccacauaauaguagauguuaggcaguuggaaccuguguugauccccuuacccgauguuaggaauaauuucuaccauuauaaucaaucaaaugaccccaccaucaaauugauagcaauguuguauacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuucguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacgaauggcucgacccgcggccacaaagcuacaguguacacugggagcgccgacuuuucuccaaaacuggguagaguucaauuugccacugacacagauaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcucccgcuguagcccccacuuucccgggugagcagcuucucuucuucagauccacuaugcccggaugcagcggguaccccaacauggauuuggacugucugcucccccaggaaugggugcaguauuucuaccaagaggcagccccagcacaaucugauguggcucuguuaagauuugugaauccagacacagguaggguucuguuugaguguaagcuucauaaaccaggcuauguuacaguggcucacacuggccaacaugauuugguuaucccccccaaugguuauuuuagauuugauuccugggucaaucaguucuacacacuugcccccaugggaaaugggacggggcguagacguuaa

SEQ ID NO: 8021 - RNA, 1617 nt, Artificial Sequence
  VP1__Norovirus_and/or_Norovirus-like__KF060018
augaagauggcgucgagugacgccaacccaucugauggguccacagccaaccucgucccagaggucaacaaugagguuauggcuuuggagcccguagucggugccgcuauugcggcaccuguagcgggccagcaaaauguaauugaccccuggauuagaaacaauuuuguucaagccccugguggagaguucacaguauccccuagaaacgcuccaggugaaauacuauggagcgcgcccuuagguccugacuugaaucccuaccuuucccauuuggccagaauguacaauaguuaugcaggugguuuugaagugcagguaauccucgcggggaaugcguucaccgccgggaaaaucauauuugcagcagucccaccaaacuucccaacugaagguuugagccccagccaagucacuauguucccccacauaauaguagauguuaggcaauuggaaccuguguugauccccuugcccgauguuaggaauaauuucuaucauuauaaucagucaaaugaccccacuaucaaauugauagcaauguuguacacaccgcuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgacccaacagaagaaaucccagccccccuaggaacuccagauuucguggggaagauucaaggcgugcucacccaaaccacaaggacagauggcucgacccgcggccacaaagcuacaguguacacugggagcgccgacuuuucuccaaaacuggguaggguucaauuugccacugacacagacaaugauuuuguaacuaaccaaaacacaaaauucaccccagucgguguuauccaggaugguaguaccaccccccgaaaugaaccccaacaaugggugcuuccaaguuacucaggcagaaacacucauaaugugcaccuggcccccgcuguagcccccacguucccgggcgagcagcuccucuucuucagaucuaccaugcccggaugcagcggguaccccaacauggauuuggacugucugcucccccaggaaugggugcaguauuucuaccaggaggcagccccggcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 8022 - RNA, 1617 nt, Artificial Sequence
  VP1__Norovirus_and/or_Norovirus-like__KC517365
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaagccauuuacugucccaauccuaacuguugaagaaaugaccaacucaagguuccccauuccuuuggagaaguuguucacgggucccagcagugccuuuguuguucaaccacaaaauggcagaugcacaacugauggcgugcucuuagacaccacccagcugucuccuguuaacaucugcaccuucagaggggaugucacccacauugcagguucucguaauuacacaaugaauuuggcuucucuaaauuggaacaacuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccgaaaugaaccucaacaaugggugcucccaaguuauucagguagaaaugucccuaaugcacaccuagccccugcuguagcccccacuuuuccgggugaacaacuccuuuucuuuagguccacuaugcccggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaaaucaggcuaugucacagcggcccacaccggccagcaugauuuggucaucccccccaaugguuauuuuagguuugauuccuggguuaaccaauucuacacgcuugcccccaugggaaacggaacggggcguagacguuaa

SEQ ID NO: 8023 - RNA, 1617 nt, Artificial Sequence
  VP1__Norovirus_and/or_Norovirus-like__KC517360
augaagauggcgucgaaugacgccagcccaucugauggguccgcagccaaccucgucccagaggucaacaaugagguuauggcuuuggagcccguugucggugccgcuauugcggcgcccguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaggucaccauguucccccauauaauaguggauguuaggcaauuggaaccuguguugauccccuuaccugauguuaggaauaauuucuaccacuauaaucagucaaaugauucuaccauuaaauugauagcaaugcuguacacaccacuuagggcuaauaaugcuggggaagaugucuuuacagucucuugucgaguucucacgaggccauccccugauuuugauuucauauuuuuggugccaccuacaguugagucaagaacuaagccauuuacugucccaaucuuaacuguugaagagaugaccaacucaagguuccccauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaaucuggcuucucuaaauuggaacaauuaugacccaacagaagaaauuccagccccucuaggaacuccagauuucgugggaaagauccaagguaugcucacucaaaccgcaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacucaccgaaaugaaccucaacaauggguacucccaaguuauucagguagaaaugucccuaauguacaccuagccccugcuguagcccccacuuuuccgggugaacaacuccuuuucuuuagguccacuaugcccggaugcagcgggugucccgacauggauuuggacugccugcuaccccaggagugggugcagcacuucuaccaagaggcagcuccagcacaaucugauguggcucuauugagauuugugaauccagacacggguaggguccuguuugagugcaaacuccauaaaucaggcuaugucacaguggcccacaccggccagcaugauuugaucaucccccccaaugguuauuuuagguuugauuccuggguuaaccaauucuacacgcuugcccccaugggaaacggaacggggcguagacguuaa

SEQ ID NO: 8024 - RNA, 1617 nt, Artificial Sequence
  VP1__Norovirus_and/or_Norovirus-like__JX846928
augaagauggcgucgagugacgccagcccaucugauggguccacagccaaccucgucccagaggucaacaaugagguuauggcuuuggagcccguagcuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaacuucuaccauuacaaucaauuaaaugaccccaccaucaaauugauagcaauguuguacacaccacuuagggcuaauaaugcuggggacgaugucuucacaguuucuugucgaguucuuacgagaccaucccccgauuuugauuucauauuuuuggugccacccacaguugaaucaagaacuaaaccauucucugucccaguuuuaacuguugaggaaaugaccaauucaagguuccccauuccuuuggaaaaguuguucacgggccccaguagugccuucguuguucaaccacaaaauggcaggugcacgacugauggcgugcuccuagguacuacccaacuguccccugucaacaucugcaccuucagaggggaugucacccauauuucaggcagucguaacuacacaaugaauuuggccucccaaaauuggaauaguuacgauccaacagaagaaaucccagccccucuaggaacuccagauuucguggggaagauucaaggugugcucacccaaaccacaaggacaaauggcucgacccgcggccacaaagcuacaguuuacacugggagcgccgacuuuucuccaaaacuggguagaguucaauuugccacugacacagacaaugauuuugaaacuaaccaaaacacaaaguucaccccagucgguguuauccaagaugguaacaccaccccccgaaaugaaccccaacaaugggugcucccaaguuacucaggcagaaacauucaaaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaagcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8025 - RNA, 1617 nt, Artificial Sequence
  VP1__Norovirus_and/or_Norovirus-like__JX459904
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgccuuuaggcccugaucugaaucccuaccuuucccauuuggccagaauguacaaugguuaugcaggugguuuugaagugcagguaauccucgcggggaaugcguucaccgccggaaaaaucauauuugcagcagucccaccaaauuucccaacugaagguuugagccccagccaagucacuauguucccccacauaauaguagauguuaggcaauuggaaccuguguugauccccuuacccgauguuagaaauaauuucuaccauuauaaucagucaaaugaccccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggaaaugaccaauucaagguuccccauuccuuuggaaaaguuguucacaggccccaguagugccuuuguuguucaaccacaaaacggcaggugcacgacugauggcgugcuccuagguacuacccaacugucuccugucaacaucugcaccuucaggggggaugucacccacauuucaggcagucguaacuacacaaugaauuuggccucccaaaauuggaacaguuaugauccaacagaagaaaucccagccccccuaggaacuccagauuucguggggaagauucaagguaugcucacccaaaccacaaggacagauggcucgacccgcggccacaaagcuacaguguacacugggagcgccgacuuuucuccaaaacugggcaggguucaauuugccacugacacagacaaugauuuuguaacuaaccaaaacacaaaguucaccccagucgguguuauccaggaugguaguacuaccccccgaaaugaaccccaacaaugggugcucccaagcuacucaggcagaaacacucauaaugugcaccuggcccccgcuguagcccccacuuucccgggcgagcagcuccucuucuucagauccaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaacaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 8026 - RNA, 1617 nt, Artificial Sequence
  VP1__Norovirus_and/or_Norovirus-like__JX459649
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaagcaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggccaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguucuccauuccuuuggaaaaauuguucacgggccccaguagugccuuuguuguucaaccacaaaacggcaggugcacgacugauggcgugcuucuagguacuacccaacugucucccgucaacaucugcaccuucagaggggacgucacccauauuccaggcagucguaacuacacaaugaauuuggccucccaaaauuggaacaguuacgauccaacagaagagaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8027 - RNA, 1617 nt, Artificial Sequence
  VP1__Norovirus_and/or_Norovirus-like__JX459643
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguugaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8028 - RNA, 1617 nt, Artificial Sequence
  VP1__Norovirus_and/or_Norovirus-like__JX459602
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagucaggucacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguucucacgaggccaucccuugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuagguaccacccaacugucuccugucaacaucugcaccuucagaggggaugucacccacauugcagguucucguaauuacacaaugaauuuggcuucucuaaauuggaacaauuaugacccaacagaagaaacuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccucaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuugcccccaugggaaauggaacggggcguagacguuaa

SEQ ID NO: 8029 - RNA, 1617 nt, Artificial Sequence
  VP1__Norovirus_and/or_Norovirus-like__LC177655
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagggcgcccuugggcccugaucuaaaucccuaucuaucccauuuggccagaauguacaaugguuaugcaggugguuuugaagugcagguaauucucgcggggaacgcguucaccgccgggaagguuauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugucgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccccccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguauacugggagcgccgacuuugcuccaaaacuggguagaguucaauuugaaacugacacagaccgugauuuugaagcuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuccauaaaucaggcuaugucacaguggcucacacuggccaacaugauuugguuaucccccccaaugguuauuuuagguuugauuccugggucaaccaguuuuacacgcuugcccccaugggaaauggaacggggcguaggcguuaa

SEQ ID NO: 8030 - RNA, 1617 nt, Artificial Sequence
  VP1__Norovirus_and/or_Norovirus-like__KP784698
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauucccuuacccgauguuaggaauaauuucuaccauuauaaccagucaaaugacuccaccaucaaacugauagcaauguuguacacaccacuuagggcuaacaaugcuggggacgaugucuucacaguuucuugucgaguucucacgagaccaucccccgauuuugauuuuauauuuuuggugccacccacagucgaaucaagaacuaaaccauucucugucccaguuuuaacuguugaggagaugaccaauucaagguuccccauuccuuuggaaaaauuguucacgggucccagcagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaagguguacucacccagaccacaaggacagauggcucaacccgcggccacaaagcuacaguguacacugggagcgccgacuuuacuccaaaacuggguaggguucaauuugccacugacacagacaaugauuuuguaacuaaucaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuauuaagauuugugaauccagacacagguaggguuuuguuugaguguaagcuucauaaaucaggcuauguuacaguggcucauacuggccaacaugauuuaguuaucccccccaaugguuauuuuagauuugauuccugggucaaccaguucuacacacuugcccccaugggaaaugggacggggcguagacguuaa

SEQ ID NO: 8031 - RNA, 1617 nt, Artificial Sequence
  VP1__Norovirus_and/or_Norovirus-like__KX354104
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauuccuuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaaccaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacauugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 8032 - RNA, 1617 nt, Artificial Sequence
  VP1__Norovirus_and/or_Norovirus-like__KR904211
augaagauggcgucgagugacgccaacccaucugauggguccacagccaaccucgucccagaggucaacaaugagguuauggcuuuggagcccguuguuggugccgccauugcggcaccuguagcgggccaacaaaaugcaauugaccccuggauuagaaacaauuuuguacaagccccugguggagaguuuacaguauccccuagaaacgcuccaggugaaauacuauggagcgcgcccuuaggcccugauuugaaucccuaccuuucucauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugacuccaccaucaaauugauagcaauguuguauacaccacuuagggcuaauaaugcuggggacgaugucuucacaguuucuugucgaguucucacgagaccaucccccgauuuugauuucauauuuuuagugccacccacaguugaaucaagaaccaaaccauucucugucccaauuuuaacuguugaggagaugaccaauucaagguuccccauuccuuuggaaaaguuguucacgggccccaguagugccuuuguuguccaaccacaaaacggcaggugcacgacugauggcgugcuccuagguacuacccaacugucuccugucaacaucugcaccuucagaggggaugucacccauauugcaggcagucguaacuacacaaugaaucuggcuucccaaaauuggaacaguuaugacccaacagaagaaaucccagccccucuaggaacuccagauuucguggggaagauucaaggugugcucacccaaaccacaaggacagauggcucgacccgcggccacaaagccacaguguacacugggagcgccgacuuuucuccaaaacuggguagaguucaauuugccacugacacagacaaugauuucgaugcuaaccaaaacacaaaguucaccccagucgguguuauccaggauggugguacuacccaccgaaaugaaccccaacaaugggugcucccaaguuacucaggcagaaauauucauaaugugcaccuggcccccgcuguagcucccacuuuuccgggugagcaacuccuuuuuuucagaucuaccaugcccggaugcagcggguaccccaacauggauuuggacugucugcucccccaagaaugggugcaguauuucuaccaggaagcagccccagcacaaucugacguggcucugcuaagauuugugaauccagacacagguaggguuuuguuugaguguaagcuucauaaaucaggcuaugucacaguggcccacacuggccaacaugauuugguuaucccccccaaugguuauuuuagauuugauuccugggucaaccaguucuacacacuugcccccaugggaaaugggacggggcguagacguuaa

SEQ ID NO: 8033 - RNA, 1617 nt, Artificial Sequence
  VP1__Norovirus_and/or_Norovirus-like__AB933743
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaaggucugagccccagccaggucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggacgaugucuucacaguuucuugccgaguucucacgagaccaucccccgauuuugauuucauauuuuuggugccacccacaguugagucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggagaugucacccauauuucaggcagucguaacuacacaaugaauuuggccucccaaaauuggaacaguuacgauccaacagaagaaaucccagccccucuaggaacuccagauuucguggggaagauucaaggugugcucacccaaaccacaaggacaaaugguucgacccgcggccacaaagcuacaguguacacugggagcgccgacuuuucuccaaaacuggguagaguccaauuugccacugacacagacaaugauuuugaaacuaaccaaaacacaaaguucaccccagucgguguuauccaggaugguaguacuaccccccgaaaugaaccccaacaaugggugcuuccaaguuacucaggcagaagcauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugagugcaagcuucauaaaucaggcuauguuacaguggcucacacuggccaacaugauuugguuaucccccccaaugguuauuuuagauuugauuccuggguuaaccaguucuacacacuugcccccaugggaaaugggacggggcguagacguuaa

SEQ ID NO: 8034 - RNA, 1617 nt, Artificial Sequence
  VP1__Norovirus_and/or_Norovirus-like__LN854572
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugaucugaaucccuaccuuucucauuuggccagaauguauaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugaccccacuaucaaauugauagcaaugcuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaauuguucacgggccccaguagugccuuuguuguucaaccacaaaauggcaggugcacgacugauggcgugcuccuagguacuacccaacuguccccugucaacaucugcaccuucagaggggaugucauccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccucaacaaugggugcucccaaguuacucaggcagaaacauucauaaugugcaccuggcccccgcuguagcccccacuuucccgggcgagcagcuccucuucuuuagaucuacuaugcccggaugcagcggguaccccaacauggauuuggacugucugcucccccaggagugggugcaguacuucuaccaggaggcagccccagcacaaucugauguggcucuguugagauuugugaauccagacacagguaggguuuuguuugaguguaagcuccauaaaucaggcuauguuacaguggcucacacuggucaacaugauuugguuaucccccccaaugguuauuuuagauuugauuccugggucaaccaguucuacacacuugcccccaugggaaaugggacggggcguagacguuaa

SEQ ID NO: 8035 - RNA, 1617 nt, Artificial Sequence
  VP1__Norovirus_and/or_Norovirus-like__KP244319
augaagauggcgucgagugacgccaacccaucugauggguccacagccaaccucgucccagaggucaacaaugagguuauggcuuuggagcccgugguuggcgccgccauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugaccugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguuuccccauauaauaguagauguuaggcaauuggaaccugugucgauccccuuacccgauguuaggaauaauuucuaucauuauaaucaaucaaaugaccccaccaucaaauugauagcaauguuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaauuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaagggcaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggauggcagcaccaccccccgaaaugaaccccaacaauggguacucccaaguuacucaggcagaaacauucauaaugugcaccuggcucccgcuguagcccccacuuucccgggcgaacagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugccccuaugggaaaugggacggggcguagacguuaa

SEQ ID NO: 8036 - RNA, 1617 nt, Artificial Sequence
  VP1__Norovirus_and/or_Norovirus-like__KF768470
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaaugcuccaggugaaauauuauggagcgcgcccuuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuucguuguucaaccacaaaauggcaggugcacgacugauggcgugcuccuagguacuacccaacuguccccugucagcaucugcaccuucagaggggaugucacccacauuccaggcagucauaacuacacaaugaauuuggccucccaaaauuggaacaguuacgacccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugcuacugacacaaacaaugauuuugaaacuaaccaaaacacaaaguucaccccagucgguguuauccaggaugguaguaccaccccccggaaugaaccccaacaaugggugcucccaaguuacucaggcagaaacauucauaaugugcacuuggcccccgcuguagcccccacuuucccgggcgagcagcuccucuucuucagaucuacuaugcccggaugcagcggguaucccaacauggauuuggacugucugcucccccaggaaugggugcaguacuucuaccaggaggcagccccagcacaaucugauguggcuuuguuaagauuugugaauccagacacagguaggguuuuguuugaguguaagcuucauaaaucaggcuauguuacaguggcucacacuggccaacaugauuugguuaucccccccaaugguuauuuuagauuugauuccuggguuaaucaguucuacacacuugcccccaugggaaacgggacggggcguagacguuaa

SEQ ID NO: 8037 - RNA, 1617 nt, Artificial Sequence
  VP1__Norovirus_and/or_Norovirus-like__KC456073
augaagauggcgucgagugacgccaacccaucugauggguccgcagccaaccucgucccaaaggucaacaaugagguuauggcucuggagcccguuguuggugccgccauugcggcaccuguagcgggccaacaaaauguaauugaccccuggauuaaaaauaauuuuguacaagccccugguggagaguuuacaguauccccuaaaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaacuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaacucaagauuccccauuccuuuggaaaaguuguucacggguccuagcagugccuuuguuguccaaccacaaaacggcaggugcacgacugacggcgugcuccuaggcaccacccaacugucuccugucaacaucugcaccuucagaggggaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgguaa

SEQ ID NO: 8038 - RNA, 1617 nt, Artificial Sequence
  VP1__Norovirus_and/or_Norovirus-like__KC456072
augaagauggcgucgagugacgccaacccaucugauggguccgcagccaaccucgucccaaaggucaacaaugagguuauggcucuggagcccguuguuggugccgccauugcggcaccuguagcgggccaacaaaauguaauugaccccuggauuaaaaauaauuuuguacaagccccugguggagaguuuacaguauccccuaaaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcaguuccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaacucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugacguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgguaa

SEQ ID NO: 8039 - RNA, 1617 nt, Artificial Sequence
  VP1__Norovirus_and/or_Norovirus-like__JX459622
augaagauggcgucgaaugacgcccacccaucugauggguccgcagccacccucgucccaaaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgaaauauuauggagcgcgcccuuaggcccugaucugaaucccuaccuaucucauuuggccagaauguauaaugguuaugcaggugguuuugaacugcaugugcuccucgcggggaacgcguucaccgccggaaaaauuauaauugcagcagucccaccaaauuuuccaacugaaggcuugagccccagccagguuacuauguucccccacauaauaguagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccccgauuuugauuuuauauuuuuggugccaccuacaguugagucaagaacuaaaccauuuacugucccaaucuuaacuguugaagaaaugacuaauucaagauuccccauuccuuuggaaaaguuguucacgggucccagcggugccuuuguuguucaaccacaaaauggcagaugcacgacugauggcgugcuccuaggcaccacccaacugucuccugucaacaucugcaucuucagaggggaugucacccacauugcagguucucguaacuacacaaugaauuuggcugcucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugccgacuuuacuccaaagcugggcaguguucaauucaguacugauacagaaaaugauuuugaaacucaccaaaacacaaaauucaccccagucggugucauccaggaugguagcaccacccaccgaaacgaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcccuauugagauuugugaauccagacacggguaggguccuguuugagugcaaacuucauaaaucaggcuaugucacaguggcucacaccggccagcaugacuuggucaucccccccaauggcuauuuuagguuugauuccuggguuaaucaauucuacacacuugcccccaugggaaauggaacggggcguagacguuaa

SEQ ID NO: 8040 - RNA, 1617 nt, Artificial Sequence
  VP1__Norovirus_and/or_Norovirus-like__KX514290
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggagugccgauuucacuccaaagcugggcaaaguucaauuugaaacugacacaacuaaugaucuugaugcucaccaaaacacaaaauucaccccagucggugucguccaggguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccucccaauggcuacuuuagguuugauuccuggguuaaucaauucuacacacuugcccccaugggaaauggaacggggcguaagcguuaa

SEQ ID NO: 8041 - RNA, 1617 nt, Artificial Sequence
  VP1__Norovirus_and/or_Norovirus-like__KP784695
augaagauggcgucgagugacgccaacccaucugauggguccacagccaaccucgucccagaggucaacaaugagguuauggcuuuggagcccgugguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugaucugaaccccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugacuccaccaucaaauugauagcaauguuguacacaccacuuagggcuaacaaugccggggacgaugucuucacagucucuugucgaguucucacgagaccaucccccgauuuugauuucauauuuuuggugccacccacaguugaaucaagaacuaaaccauuuucugucccaguuuuaacuguugaggagaugaccaauucaagguuccccauuccuuuggaaaaguuguucacgggucccaguagugccuuuguuguucaaccacaaaauggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccggccccccuaggaacuccagauuucguggggaagauccaaggugugcucacccagaccacaaggacagauggcucgacccgcggccacaaagcuacaguguacacugggagcgccgacuuuucuccaaaacuggguaggguucaauuugcuacugacacagacaaugauuuuguaacuaaucaaaacacaaaguucaccccagucgguguuauccaggaugguaauacuaccccccgaaaugaaccccaacaaugggugcucccaaguuacucagguagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuauuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 8042 - RNA, 1617 nt, Artificial Sequence
  VP1__Norovirus_and/or_Norovirus-like__KX608865
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguguccccuagaaacgcuccaggugaaauacuauggagcgcgcccuuaggcccugauuugaaucccuaccuuucccauuuggccagaauguacaacgguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugacuccaccaucaaauugauagcaauguuguacacaccacuuagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauugcaggcagucgcaacuacacaaugaauuuggccucccaaaauuggaacaguuacgauccgacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaucagaauacaaaguucaccccagucgguguuauccaggauggcaguacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 8043 - RNA, 1617 nt, Artificial Sequence
  VP1__Norovirus_and/or_Norovirus-like__AB972500
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcaggugauccucgcggggaacgcguucaccgccgggaaaaucauauuugcagcagucccaccaaauuucccaacugaagguuugagccccagccaagucaccauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacuacugauggcgugcuccuagguaccacccaacugucuccugucaacaucugcaccuucagaggggaugucacccauauuucaggcagucguaacuacacaaugaauuuggccucccaaaauuggaacaguuacgauccaacagaagaaaucccagccccuuuaggaacuccagauuucguggggaagauucaaggugugcuuacccaaaccacaaggacaaauggcucgacccgcggccacaaagcuacaguguacacugggagcgccgacuuuucuccaaaacuggguagaguccaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagccccuacuuucccgggcgagcagcuucucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8044 - RNA, 1617 nt, Artificial Sequence
  VP1__Norovirus_and/or_Norovirus-like__KT033902
augaagauggcgucgagugacgccaacccaucugauggguccacagccaaccucaucccagaggucaacaaugagguuauggcuuuagagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgauaucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaagcuguucacgggccccaguagugcccuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucgugggaaaaauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucggcguuauccaggaugguaguacuaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 8045 - RNA, 1617 nt, Artificial Sequence
  VP1__Norovirus_and/or_Norovirus-like__KR904220
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucguggggaaugcguucaccgccgggaaaaucauauuugcagcagucccaccaaauuucccaacugaagguuugagccccagucaagucacuauguucccccacauaauaguagauguuaggcaauuggaaccuguguugaucccccuacccgauguuaggaauaauuucuaccauuauaaccagucaagugacuccaccaucaaauugauagcaauguuguacacaccacuuagggcuaacaaugcuggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaacuguucacgggucccaguagugccuuuguuguucaaccacaaaacggcaggugcacgacugauggcgugcuccuagguacuacccaacugucuccugucaacauuugcaccuucagaggggaugucacccacauuucaggcagucauaacuacacaaugaauuuggccucccaaaauuggaacaguuacgauccaacagaagaaaucccagccccccuaggaacuccagauuucguggggaagauucaagguguacucacccagaccacaaggacagauggcucaacccgcggccacaaagcuacaguguacacugggagcaccgacuuuacuccaaaacuggguagggcucaauuugccacugacacagacaaugauuuugaaacuaaucaaaacacaaaguucaccccagucgguguuauccaggauggugguacuacccaccgaaaugaaccccaacaaugggugcucccaaguuacucgggcagaaacacucauaacgugcaccuggcccccgcuguagcccccacuuucccgggcgagcagcuucucuucuucagaucuaccaugcccggaugcagcggguaccccaacauggauuuggacugucugcucccccaggaaugggugcaguauuucuaccaggaggcagccccagcacaaucugauguggcauuauuaagauuugugaauccagacacagguaggguuuuguuugaguguaagcuucauaaaucaggcuauguuacaguggcucauacuggccaacaugauuuaguuaucccccccaaugguuauuuuagauuugauuccugggucaaccaguucuacacacuugcccccaugggaaaugggacggggcgcagacguuaa

SEQ ID NO: 8046 - RNA, 1617 nt, Artificial Sequence
  VP1__Norovirus_and/or_Norovirus-like__LN854566
augaagauggcgucgagugacgccaacccaucugauggguccgcagccaaccucguaccagaggucaacaaugagguuauggcucuggagcccguuguuggugccgcuauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugaucuaaaucccuaccuaucccacuuagcuagaauguacaaugguuaugcaggugguuuugaagugcagguaauucucgcggggaacgcguucaccgcugggaagaucauauuugcagcagucccaccaaauuuuccaacugaaggcuuaagccccagccagguuacuauguucccccauauaauaguagauguuagacaacuagaaccugugcugauucccuuacccgaugucaggaauaauuucuaucauuacaaucaaucaaaugacuccacuauuaaguugauagcaauguuguauacaccacuuagggcuaauaaugcuggggacgaugucuucacaguuucuugccgaguucucacgagaccaucccccgauuuugauuuuauauuuuuagugccacccacaguugagucaagaacuaagccauucucugucccaguuuuaacuguugaggagaugaccaauucaagauuccccaucccuuuggaaaaguuguucacgggucccagcagugccuuuguuguucaaccacaaaacggcaggugcacgacugauggcgugcuccuaggcaccacccaacuguccccugucaacaucugcaccuucagaggggauguuagccacaucacagguagucguaacuacacaaugaauuuggcuucucaaaauuggaacaauuaugacccaacagaagaaaucccagccccucuaggaacuccagauuuuguggggaagauucaaggcaugcucacucaaaccacaagggcagaugguucaacacgcggccacaaagcuacaguguacacugggagcgccgacuuugcuccaaaacuggguagaguucaauuugaaacugacacagaccaugauuuugaagcuaaccaaaacacaaaguucaccccggucggugucauccaagaugguagcaccacccaccgaaaugaaccccaacagugggugcucccaaguuacucaggcagaaauacucacaaugugcaucuggcccccgcuguagcccccacuuuuccgggugaacaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucagguuauguuacaguggcucacacuggucaacaugauuugguuauuccccccaacgguuacuuuagguuugauuccugggucaaccaguucuacacgcuugcccccaugggaaauggaacggggcguagacguuaa

SEQ ID NO: 8047 - RNA, 1617 nt, Artificial Sequence
  VP1__Norovirus_and/or_Norovirus-like__KP244313
augaagauggcgucgagugacgccaacccaucugauggguccacagccaaccucgucccagaggucaacaaugagguuauggcuuuggagcccguaguuggugccgccaucgcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccacuuggccagaauguacaaugguuaugcaggugguuuugaagugcaggugauccuugcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacucaacugucuccugucaacaucugcaccuucagaggggaugucacccauauuucaggcagucguaacuacacaaugaauuuggccucccaaaauuggaacaguuacgauccaacagaagaaaucccagccccucuaggaacuccagauuucguggggaagauucaaggugugcucacccaagccacaaggacaaauggcucgacccgcggccacaaagcuacaguguacacugggagcgccgacuuuucuccaaaacuggguagaguucaauuugccacugacacagacaaugauuuugaaacuaaccaaaacacaaaauucaccccagucggcguuauccaggaugguaguacuaccccccgaaaugaaccccaacaaugggugcucccaaguuacucaggcagaaacauucacaaugugcaccuggcccccgcuguagccccuacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaacccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 8048 - RNA, 1617 nt, Artificial Sequence
  VP1__Norovirus_and/or_Norovirus-like__KP096342
augaagauggcgucgagugacgccaacccaucugauggguccgcagccaaccucgucccagaggucagcaaugagguuauggcucuggagcccguuguuggugccgccauugcagcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcaggugauucucgcggggaaugcguucaccgccgggaagguuauauuugcagcagucccaccaaauuuuccaacugaaggcuugagccccagccagguuacuauguucccccauauaguaguagauguuaggcaguuggaaccuguguugauucccuuacccgauguuaggaauaauuuuuaucauuacaaucaaucaaaugaucccaccauuaaguugauagcaauguuguauacaccacuuagggcuaauaaugcuggggaugaugucuucacaguuucuugccgaguucucacgagaccaucccccgauuuugauuuuauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaacacucccaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugccccuaugggaaauggaacggggcguaaacguuaa

SEQ ID NO: 8049 - RNA, 1617 nt, Artificial Sequence
  VP1__Norovirus_and/or_Norovirus-like__KM514067
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaccccuaccuaucccauuuggccagaauguacaaugguuaugcagguggcuuugaagugcagguaauucucgcggggaacgcguucaccgccgggaaagucauauuugcagcagucccaccaaauuuuccaacugaaggcuugagccccagccaggucacuauguucccccauauaguaguagauguuaggcaauuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgaggccaucccccgauuuugauuucauauuucuagugccacccacaguugagucaagaacuaaaccauucucugucccaguuuuaacuguugaggaaaugaccaauucaagauuccccaucccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagacuuuguggggaagauucaaggcgugcucacccaaaccacaaggacagauggcucaacacgcggccacaaagccacaguguacacugggagcgcugacuuugcuccaaaacugggcagaguucaauuugaaacugacacagaccaugauuuugaagcuaaccaaaacacaaaguucaccccaguuggugucauccaagaugguggcaccacccaccgaaaugaaccccaacagugggugcuuccaaguuacucaggcagaaauacuccuaaugugcaucuggcccccgcuguagcccccacuuuuccgggugagcaacuucucuucuucagauccaccaugcccggaugcagcggguaccccaacauggacuuggacugccugcuccccccggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 8050 - RNA, 1617 nt, Artificial Sequence
  VP1__Norovirus_and/or_Norovirus-like__KF060049
augaagauggcgucgagugacgccaacccaucugauggguccacagccaaccucgucccagaggucaacaaugagguuauggcuuuggagcccguaguuggugccgcuauugcggcaccuguagcgggccagcaaaauauaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuacgcaggugguuuugaagugcagguaauccucgcggggaaugcguucaccgccgggaaaaucauauuugcagcagucccaccaaauuucccaacugaagguuugagccccagccaaguuacuauguucccccacauaauaguagauguuaggcaauuggaaccuguguugauccccuuacccgauguuaggaauaauuucuaccauuauaaucagucaaaugacuccaccaucaaauugauagcaauguuguacacaccacuuagggcuaacaaugccggggacgaugucuucacaguuucuugucgaguucucacgagaccaucccccgauuuugauuucauauuuuuggugccacccacaguugagucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaagcuggguaggguucaauuugccacugacacagacaaugauuuuguaacuaaucaaaacacaaaguucaccccagucgguguuauccaggaugguaguaccaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggauguagcggguaccccaacauggauuuggacugucugcucccccaggaaugggugcaguauuucuaccaggaggcagccccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 8051 - RNA, 1617 nt, Artificial Sequence
  VP1__Norovirus_and/or_Norovirus-like__KF059998
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugacuugaaucccuaccuuucccaucuggccagaauguauaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaguuggaaccuguguugauccccuuacccgauguuaggaauaauuucuaccauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacuaucuccugucaacaucugcaccuucagaggggacgucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuagugcaaauggcucgacccgcggccacaaagcuacaguguacacugggagcgccgacuuuucuccaaaacugggcagaguucaguuugccacugacacaaacaaugauuuugaaacuaaccaaaacacaaaauucaccccagucggcguuauccaggaugguaauacuaccccccgaaaugaaccccaacaaugggugcucccaaguuacucaggcagaaacauucacaaugugcaccuggcccccgcuguggcccccacuuucccgggcgaacagcuccucuucuucagaucuacuaugcccggaugcagcggguaccccaacauggauuuggauugucugcucccccaggaaugggugcaguacuucuaccaggaggcagccccagcacaaucugauguggcccuguuaagauuugugaauccagacacagguaggguuuuguuugaguguaagcuucauaaaucaggcuauguuacaguggcucauacuggccagcaugauuugguuaucccccccaaugguuauuuuagauuugacuccugggucaaccaguucuacacacuugcccccaugggaaaugggacggggcguagacguuaa

SEQ ID NO: 8052 - RNA, 1617 nt, Artificial Sequence
  VP1__Norovirus_and/or_Norovirus-like__JX439833
augaagauggcgucgagugacgccaacccaucugauggguccaaagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagccauguuguacacaccacuuagggcuaauaaugccggggacgaugucuucacagucucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacggauggcguacuccuagguacuacccaacugucccccgucaacaucugcaccuucagaggggaugucacccauauuccaggcagucgcaacuacacaaugaauuuggccucccaaaauuggaacaguuacgauccaacagaagaaaucccagccccccuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguuuuacacacuugcccccaugggaaaugggacggggaguagacguuaa

SEQ ID NO: 8053 - RNA, 1617 nt, Artificial Sequence
  VP1__Norovirus_and/or_Norovirus-like__JQ613548
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuaucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggaugaugucuuuacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacgacugauggcgugcuccuagguacuacccaacugucuccugucaacaucugcaccuucagaggggaugucacccauauuucaggcagucguaacuacacaaugaauuuggccucccaaaauuggaacaguuacgauccagcagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauucgccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuucucuucuucagaucuacuaugcccggaugcagcggguaccccaacauggacuuggacugucugcucccccaggaaugggugcaguacuucuaucaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8054 - RNA, 1617 nt, Artificial Sequence
  VP1__Norovirus_and/or_Norovirus-like__JN595867
augaagauggcgucgagugacgccaacccaucugauggguccacagccaaccuugucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaaugccccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccgaauuucccaacugaagguuugagccccagccaggucacuauguucccccacauaauaguagauguuaggcaauuggaaccuguguuaauccccuuacccgauguuaggaauaauuucuaccauuauaaucaaucaaaugaucccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucacccauauuccaggcagucguaacuacacaaugaauuuggccucccaaaauuggaacaguuacgauccaacagaagaaaccccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguggcccccacuuucccgggcgagcagcuccucuucuucagaucuacuaugcccggaugcagcggguaccccaauauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8055 - RNA, 1617 nt, Artificial Sequence
  VP1__Norovirus_and/or_Norovirus-like__AB629944
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaccccuaccuuucccauuuggccagaauguacaaugguuaugcaggugguuuugaagugcagguaauccucgcggggaaugcguucaccgccgggaaaaucauauuugcagcagucccaccaaauuuuccaacugaagguuugagccccagccaggucacuauguucccccacauaauaguagauguuaggcaauuggaaccuguguugauucccuuacccgauguuaggaauaauuucuaccauuauaaucaaucaaaugaccccacuaucaaauuaauagcaauguuguauacaccacucagggcuaacaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuucccauuccuuuggaaaaguuguucacgggcccuaguagugccuuuguuguucaaccacaaaacggcaggugcacgacugauggcgugcuccuagguacuacccaacugucuccugucaacaucugcaccuucagaggggaugucacccauauuucaggcagucguaacuacacaaugaauuuggccucccaaaauuggaacaguuacgauccaacagaagaaaucccagccccuuuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacacucauaaugugcaccuggcccccgcuguagcccccacuuucccgggcgagcagcuccucuuuuucagauccacuaugccuggaugcagcggguaccccaacauggauuuggacugucugcucccccaggaaugggugcaguauuucuaccaggaggcagccccagcacaaucugauguggcucuguuaagauuugugaauccagacacagguaggguuuuguuugaguguaagcuucauaaaucaagcuauguuacaguggcucacacuggccaacaugauuugguuaucccucccaauggcuauuuuagauuugauuccugggucaaccaguucuacacacuugcccccaugggaaaugggacggggcguagacauuaa

SEQ ID NO: 8056 - RNA, 1617 nt, Artificial Sequence
  VP1__Norovirus_and/or_Norovirus-like__AB541192
augaagauggcgucgagugacgccaacccaccugauggguccgcagccaaccucgucccagaggucaacaaugagguuauggcuuuggagcccguugucggugccgcuauugcggcgccuguggcgggccaacaaaauguaauugaccccuggauuagaaauaauuuugugcaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcaguuccaccaaauuuuccaacugagggcuugagucccagccaggucacuauguucccccacauaauaguagauguuaggcaauuggaaccuguguuaauccccuuaccugauguuaggaauaauuucuaucacuauaaccagucaaaugauucuaccauuaaauugauagcaaugcuguauacaccacuuagggcuaauaaugcuggggaagaugucuucacagucucuugucgaguccucacgaggccauccccugauuuugauuuuauauucuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugccacccacauugcagguucucguagcuacacaaugaauuuggcuucucuaaauuggaacaauuaugacccaacagaagaaauuccagccccucuaggaacuccagauuucgugggaaagauccaagguaugcucacucaaaccacaaagggagauggcucgacccguggccauaaagcuacaguuuacacugggagugcccccuuuacuccaaagcugggcaguguucaauucaguacugauacagaaaaugauuuucaaacucaccaaaacacaaaauucaccccagucggugucauccaggaugguagcaccacccaccgaaaugaaccccaacaaugggugcucccaaguuauucagguagagauguccauaauguacaccuagccccugcuguagcccccacuuucccgggugaacaacuucuuuucuucagguccacuaugcccggaugcagcggguaucccaacauggauuuggauugccuacucccccaggagugggugcagcacuucuaccaagaggcggcuccagcacaaucugauguggcucuauugagauuugugaauccagacacggguaggguccuguuugagugcaaacuucauaaaucaggcuaugucacaguggcucacaccggccagcaugauuuggucaucccccccaauggcuacuuuagguuugauuccuggguuaaucaauucuacacacuugcccccaugggaaauggaacggggcguagacguuaa

SEQ ID NO: 8057 - RNA, 1617 nt, Artificial Sequence
  VP1__Norovirus_and/or_Norovirus-like__AB504314
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaacccauaccuuucucaccuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuagacaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggcgaugucacccacauuccaggcacucguacuuacagaaugaauuuggcuucucaaaauuggaacaauuaugacccaacagaagaaaucccagccccucugggaacuccagauuucgugggaaggauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauccaggaugguaguagugcccucagaaaugaaccccaacaauggguacucccagauuacucagguagaacuguucauaauguacaccuagccccugccguggcccucacuuuuccgggugagcaacuucuuuucuucagaucuacuaugcccggaugcaguggguaucccaauauggauuuggacugucuacucccccaggaaugggugcagcacuucuaccaagaggcagccccaucacaaucugauguggcuuugcugagauuugugaauccagacacagguaggguucuguuugagugcaagcuucauagagcaggcuaugucacaguggcucacacuggccagcaugacuugguuaucccccccaauggcuacuucagauuugauuccuggguuaaccaguucuacacacucgcccccaugggaaauggagcggggcguagacguuaa

SEQ ID NO: 8058 - RNA, 1617 nt, Artificial Sequence
  VP1__Norovirus_and/or_Norovirus-like__KX514350
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguacacaccacuuagggccaauaaugcuggggaugaugucuucacagucuccugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccaaucugggaacacuaaaauuuacacaaugaauuuggccucuccaaauuggaacaauuaugacccaacagaagagauuccagccccucugggaacuccagauuuuguaggaaagauccaagguaugcucacucaaaccacaaagggagaagguucgacccggggccauagagcuacaguauauguugggagugccaacuaugcuccaaagcuagguagaguucaauuugaaacugacacaacugaugaucuugaugcucaccaaaacacaaaauucaccccagucggugucguccagaguggugaaucccccaaaggaagugaaccccaacaaugggugcucccaaguuauucagguagagauacccccaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucauccccccuaauggcuacuuuagguuugauuccuggguuaaucaauucuacacacuugcccccaugggaaauggaacggggcguaagcguuaa

SEQ ID NO: 8059 - RNA, 1617 nt, Artificial Sequence
  VP1__Norovirus_and/or_Norovirus-like__KX514342
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguacacaccacuuagggccaauaaugcuggggaugaugucuucacagucuccugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccaaucugggaacacuaaaauuuacacaaugaauuuggccucuccaaauuggaacaauuaugacccaacagaagagauuccagccccucugggaacuccagauuuuguaggaaagauccaagguaugcucacucaaaccacaaagggagaagguucgacccggggccauagagcuacaguauauguugggagugccaacuaugcuccaaagcuagguagaguucaauuugaaacugacacaacugaugaucuugaugcucaccaaaacacaaaauucaccccagucggugucguccagaguggugaaucccccaaaggaagugaaccccaacaaugggugcucccaaguuauucagguagagauacccccaauguacaucuagccccugcuguagcccccacuuucccgggugaacaacuucuuuucuucagauccacuauacccggauguggcgggcaccccaacauggacuuggauugccugcucccccaggagugggugcagcacuucuaccaagaggcagcuccagcacaaucugauguggcucuacugagauuugugaauccagacacgaguaggguccuguuugagugcaaacuucauaaaucagguuaugucacaguggcucacaccggucaacaugauuuggucauccccccuaauggcuacuuuagguuugauuccuggguuaaucaauucuacacacuugcccccaugggaaauggaacggggcguaagcguuaa

SEQ ID NO: 8060 - RNA, 1617 nt, Artificial Sequence
  VP1__Norovirus_and/or_Norovirus-like__KX514280
augaagauggcgucgaaugacgccaacccaucugauggguccacagccaaccucgucccagaggucaacaaugagguuauggcuuuggagcccguugucggugccgcuaucgcggcgccuguagcgggccaacaaaauguaauugaccccuggauuagaaauaauuuuguacaagccccugguggagaguucacaguauccccuagaaacgcuccgggugaaauacuauggagcgcgcccuuagguccugaucugaaucccuaccuaucucauuuggcuagaauguauaaugguuaugcaggugguuuugaagugcaggugauccucgcggggaaugcguuuaccgcgggaaaaaucauauuugcagcagucccuccaaauuuuccaacugaaggcuugagucccagccaggucacuauguucccccauauaauaguagauguuaggcaauuagaaccuguguugauccccuuaccugauguuaggaacaacuucuaucauuacaaucagucaaaggacuccaccauuaaauugauagcaaugcuguauacaccacuuagggccaauaaugcuggggaugaugucuucacaguuucuugccgaguccucacgaggccauccccugauuuugacuucauauuccuggugccaccuacaguugagucaaggucuaagcccuuuucugucccagucuuaacuguugaagaaaugaccaauucaagauuccccguuacuuuggauaaauuguucacaggucccagcagcaccauuguuguucaaccacaaaauggcagaugcacgauugauggcgugcucuuaggcaccacccaacuguccccugucaacauuugcaccuucagaggggacgucacccacccuagggacucuacaauuuacacaaugaauuuggccucuccaaauuggaacacuuaugacccaacagaagaaauuccagccccucugggaacuccagacuuugugggaaagauccaagguaugcucacucaaaccacaaagggagcagguucgacccggggccauagagcuacaguuuauguugggagugccaacuaugccccaaagcuggguagaguucaauuugaaacuaacacaagugaugaucuugaugcucaccaaaacacaaaauucaccccagucggugucauccaggguggugaauccgcccaccgaagugaaccccaacaaugggugcucccaaguuauucagguagagauaucccuaauguacaucuagccccugcuguagcccccacuuucccgggugaacaacuucuuuucuucagguccacuauacccggaugcggcgggcaucccaacauggauuuggauugccuacucccccaggagugggugcaacacuucuaccaagaggcagcuccagcacaaucugauguggcucuauugagauuugugaauccagacacaaguaggguucuguuugagugcaaacuucauaaaucagguuaugucacaguggcucacaccggucaacaugauuugguuaucccccccaauggcuacuuuagauuugauuccugggucaaucaauucuacacacuugcccccaugggaaauggaacggggcguaagcguuaa

SEQ ID NO: 8061 - RNA, 1617 nt, Artificial Sequence
  VP1__Norovirus_and/or_Norovirus-like__LC177654
augaagauggcgucgagugacgccaacccaucugauggguccacagccaaccucguuccagaggucaacaaugaggucauggcuuuggagcccguaguuggugccgccauugcggcaccuguggcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaaccgaagguuugagccccagccaggucacuauguucccccacauaauaguugauguuaggcaauuggaaccuguguugauccccuuacccgauguuaggaauaauuucuaucauuauaaccaaucaaaugauuccaccaucaaauugauagcaauguuguacacaccacuuagggcuaauaaugccggggaugaugucuucacaguuucuugucgaguucucacgagaccaucccccgauuuugauuuuauauucuugguaccacccacaguugaaucaagaacuaaaccauucucugucccaguuuuaacuguggaggagaugaccaauucaagguuccccauuccuuuggaaaaguuguucacgggccccaguagugccuuuguuguucaaccacaaaacggcaggugcacgacugauggcgugcuccuagguaccacucaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacucgcggccauaaagcuacaguguacacugggagcgccgauuuuuccccaaaacugggcagaguucaauuugccacugauacagacaaugauuuugaaacuaaccaaaacacaaaauucaccccagucggcguuauccaggaugguaguacuaccccccgaaaugaaccccaacaaugggugcucccaaguuacucaggcagaaacauucacaaugugcaccuggcccccgcuguagcccccacuuucccgggcgagcagcuccucuucuucaggucuacuaugcccggaugcagcggguaccccaacauggacuuggauugucugcucccccaggaaugggugcaguacuucuaccaggaggcagccccagcacaaucugauguggcucuguuaagauuugugaauccagacacagguaggguuuuguuugaguguaagcuccauaaaucaggcuauguuacaguggcucauacuggccaacaugauuugguuaucccccccaaugguuauuuuagauuugauuccugggucaaccaguucuacacacuugcccccaugggaaaugggacggggcguaggcguuaa

SEQ ID NO: 8062 - RNA, 1617 nt, Artificial Sequence
  VP1__Norovirus_and/or_Norovirus-like__KX354026
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggcuagaauguacaaugguuaugcaggugguuuugaagugcaggugauccucgcggggaacgcguucaccgccgggaaaaucauauuugcagcagucccaccaaauuucccaacugaagguuugagccccagccaggucacuauguucccacacauaauaguagauguuaggcaauuggaaccuguguugauccccuuacccgauguuaggaauaauuucuaucauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaauuuuaacuguugaggagaugaccaauucaagguuccccauucccuuggaaaaguuguucacgggccccaguagugccuuuguuguucaaccacaaaacggcaggugcacgacugauggcgugcuccuagguaccacucaacugucuccugucaacaucugcaccuucagaggggaugucacccauauuccaggcagucauaacuacacaaugaauuuggccucccaaaauuggaacaguuacgacccaacagaagaaaucccagccccucuaggaaccccagauuucguggggaagauucaaggugugcucacucaaaccacuaguacaaauggcucgacccgcggccacaaagcuacaguguacacugggagcgccgacuuuucuccaaaacuggguagaguucaauuugccacugacacaaacaacgauuuugaaacuaaccaaaacacaaaauucaccccagucggcguuauccaggaugguaguaccaccccccgaaaugaaccccaacaaugggugcucccaaguuacucagguagaaacauucacaaugugcaccuggcccccgcuguagcccccacuuucccgggcgagcagcuccucuucuucagaucuacuaugcccggaugcagcggguaccccaacauggaccuagauugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 8063 - RNA, 1617 nt, Artificial Sequence
  VP1__Norovirus_and/or_Norovirus-like__KR904218
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccgcauaauaguagauguuaggcaauuggaaccuguguuaauccccuuacccgauguuaggaauaauuucuaucauuauaaucaaucaaaugaccccaccaucaaauugauagcaauguuguauacaccacuuagggcuaauaaugcuggggacgaugucuucacaguuucuugucgaguucucacgagaccaucccccgauuuugauuuuauauucuuagugccacccacaguugaaucaagaaccaaaccauucucugucccaauuuuaacuguugaggagaugacuaauucaagguuccccaucccuuuggaaaaguuguucacgggccccaguagugccuuuguuguucaaccacaaaacggcaggugcucgacugauggcgugcuccuagguacuacccaacugucuccugucaacaucugcaccuucagaggggaugucacccauauugcaggcagucauaacuacacaaugaaucuggcuucccaaaauuggagcaguuaugacccaacagaagaaaucccagccccucuaggaacuccagauuucguggggaagauucaaggugugcucacccaaaccacaaggacagauggcucgacccgcggucacaaagcuacaguguacacugggagugccgacuuuucuccaaaacuggguagaguucaauuugccacugacacaaacaaugauuuugaaucuaaccaaaacacaaaguucgccccagucgguguuauccaggauggugguacugcccaccgaaaugaaccccaacaaugggugcuuccaaguuacucaggcagaaauauucauaaugugcaccuggcccccgcuguggcccccacuuuuccgggugagcaacuccucuucuuuagaucuaccauacccggaugcagcggguaccccaacauggauuuggacugccugcucccccaggaaugggugcaguacuucuaccaggaagcagccccagcacaaucugauguggcucugcuaagguuugugaauccagacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcgcagacgauaa

SEQ ID NO: 8064 - RNA, 1617 nt, Artificial Sequence
  VP1__Norovirus_and/or_Norovirus-like__KJ678150
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuuaaaucccuaccuaucccauuuggccagaauguacaaugguuaugcaggugguuuugaagugcaggugauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguucaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuucguggggaagauucaaggcgugcucacccaaaccacaaggacagauggcucaacacgcggccacaaagccacaguguacacugggagcgccgacuuugcuccaaaacugggcagaguucaauuugaaacugacacagaccaugauuuugaaacuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 8065 - RNA, 1617 nt, Artificial Sequence
  VP1__Norovirus_and/or_Norovirus-like__KJ678148
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguucaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuucguggggaagauucaaggcgugcucacccaaaccacaaggacagauggcucaacacgcggccacaaagccacaguguacacugggagcgccgacuuugcuccaaaacugggcagaguucaauuugaaacugacacagaccaugauuuugaaacuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccauacccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 8066 - RNA, 1617 nt, Artificial Sequence
  VP1__Norovirus_and/or_Norovirus-like__KP244316
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaagcaauuuuguacaagccccugguggagaguuuacaguaucccccagaaacgcuccaggugaaauacuauggagcgcacccuuaggcccugauuugaaucccuaccucucccauuuggccagaauguacaaugguuaugcaggugguuuugaagugcagguaauccucgcggggaacgcguucaccgccgggaaaaucauauuugcagcagucccaccaaauuucccaacugaagguuugagccccagucaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcagaugcacgacugauggcgugcuccuagguacuacccaacugucucccgucaacaucugcaccuucagaggggaugucacccacauuucaggcagucguaacuacacaaugaauuuggcuucccaaaauuggaacaguuacgauccaacagaagaaaucccagccccucuaggaacuccagauuucguggggaagacucaaggugugcucacccaaaccacaaagacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgagaugaaccccagcaaugggugcucccaaguuacucaggcagaaacacccauaauguacaccuggcccccgcuguagcccccacuuucccgggcgagcagcuccucuucuucagaucuacuaugcccggaugcagcggguaccccaacauggaucuggaccgucugcucccccaggagugggugcaguauuucuaucaggagccagccccagcacaaucugacguggcucuguuaagauuugugaauccagauacagguaggguuuuguuugaguguaagcuucauaaaucaggcuauguuacaguggcucacacuggccaacaugauuugguuaucccccccaaugguuauuuuagauuugauuccugggucaaucaguucuauacacuugcccccaugggaaaugggacggggcguagacguuaa

SEQ ID NO: 8067 - RNA, 1617 nt, Artificial Sequence
  VP1__Norovirus_and/or_Norovirus-like__KF060072
augaagauggcgucgagugacgccaacccaucugauggguccgcagccaaccucgucccagaggucaacaaugagguuauggcuuuggagcccguaguuggugccgcuauugcggcaccuguagcgggccaacaaaacgugauugaccccuggauuagaaacaauuuuguacaagccccugguggagaguuuacaguauccccuagaaacgcuccaggugaaauacuauggagcgcgcccuugggcccugauuugaaucccuaccuaucccauuuggccagaauguacaaugguuaugcaggugguuuugaagugcagguaauccucgcggggaaugcguucaccgcugggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucagucaaaugacuccaccaucaaauugauagcaauguuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucuguaccuucagaggggaugucacccacauuucaggcagucguaacuacacaaugaauuuggccucccaaaauuggaacaguuacgauccaacagaagaaaucccagccccccuaggaacuccagacuucguggggaagauucaaggugugcucacccaaaccacaagaacagauggcucgacccgcggccacaaagcuacaguguacacugggagcgccgacuuuucuccaaaacuggguaggguucaauuugccacugacacagacaaugauuuuauaacuaaccaaaacacaaaguucaccccagucgguguuauccaggaugguagcacuaccccccgaaaugaaccccaacaaugggugcucccaaguuacucaggcagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuguugagauuugugaauccagacacagguaggguuuuguuugaguguaagcuucauaaaccaggcuauguuacaguggcccacacuggccaacaugauuuaguuaucccccccaauggcuauuuuagauuugauuccugggucaaccaguucuacacacuugccccuaugggaaaugggacggggcguagacguuaa

SEQ ID NO: 8068 - RNA, 1617 nt, Artificial Sequence
  VP1__Norovirus_and/or_Norovirus-like__JX439822
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacagucucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacggauggcguacuccuagguacuacccaacugucccccgucaacaucugcaccuucagaggggaugucacccauauuccaggcagucgcaacuacacaaugaauuuggccucccaaaauuggaacaguuacgauccaacagaagaaaucccagccccccuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguuuuacacacuugcccccaugggaaaugggacggggaguagacguuaa

SEQ ID NO: 8069 - RNA, 1617 nt, Artificial Sequence
  VP1__Norovirus_and/or_Norovirus-like__KC463910
augaagauggcgucgagugacgccaacccaucugauggguccacagccaaccucgucccagaggucaacaaugagguuauggcuuuggagcccgugguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauacucgcggggaacgcguucaccgccgggaaaaucauauuugcagcagucccaccaaauuucccaacugaagguuugagccccagccaggucacuauguucccccacauaauaguagaugucaggcaauuggaaccuguguugauccccuuacccgauguuaggaauaauuucuaccauuauaaucaaucaaaugauuccaccaucaaauugauagcaauguuguacacgccacuuagggcuaauaaugccggggaugaugucuucacaguuucuugucgaguucuuacgagaccaucccccgauuuugauuuuauauuuuuggugccacccacaguugaaucaagaacuaaaccauuuucugucccaauuuuaacuguugaggagaugaccaauucaagguuccccauuccuuuggaaaaguuguucacaggccccaguagugccuuuguuguccaaccacaaaacggcaggugcacgacugauggcgugcuccuagguaccacucaacugucuccugucaacaucugcaccuucagaggggaugucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacuggguagaguucaauuuuccacugacacaaacaaugauuuugaaacuaaccaaaauacaaaauucaccccagucggcguuauccaggaugguaguacuaccccccgaaaugaaccccaacaaugggugcucccaaguuacucaggcagaaacauucacaaugugcaccuagcccccgcuguggcccccacuuucccgggcgagcagcuccucuucuucagaucuacuaugcccggaugcagcggguaccccaacauggauuuggauugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 8070 - RNA, 1617 nt, Artificial Sequence
  VP1__Norovirus_and/or_Norovirus-like__JX459651
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguucuccauuccuuuggaaaaguuguucacgggccccaguagugccuuuguuguucaaccacaaaacggcaggugcacgacugauggcgugcuccuagguacuacccaacugucucccgucaauaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8071 - RNA, 1617 nt, Artificial Sequence
  VP1__Norovirus_and/or_Norovirus-like__AB541314
augaagauggcgucgagugacgccaacccaucugauggguccgcagccaaccucgucccagaggucaacaaugagguuauggcuuuggagcccguuguuggugccgcuauugcggcgccuguagcgggccaacaaaauguaauugaccccuggauuagaaauaauuuuguacaagccccugguggagaguucacaguaucuccuagaaacgcuccaggugaaauacuauggagcgcgcccuuagguccugaucugaaucccuaccuaucucauuuggccagaauguacaaugguuaugcaggugguuuugaagugcaggugauccucgcggggaacgcguucaccgccggaaagauuauauuugcagcagucccaccaaauuucccaacugaaggcuugagucccagccaggucacuauguucccccacauaauaguggauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaaguugucuuuacagucucuugucgaguucucacgaggccauccccugauuuugauuuuauaugcuuggugccaccuacaguugagucaagaacuaaaccauuuacugucccaaucuuaacuguugaggaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuauacugggagugcccccuuuacuccaaagcugggcaguguccaauucaguacugauacagaaaaugauuuugaaacucaucaaaacacaaaauucaccccagucggugucauccaggaugguggcaccacccaccgaaaugaaccccaacaaugggugcucccaaguuauucagguagaaaugucccuaauguacacuuagccccugcuguagcccccacuuuuccgggugaacagcuucuuuucuuuagguccacuaugcccggaugcagcggguaucccaacauggauuuggauugccuacucccccaggagugggugcagcacuucuaccaagaggcagcuccagcacaaucugauguggcucuauugagauuugugaauccagacacgggaaggguccuguuugagugcaaacuccauaaaccaggcuaugucacaguggcucacaccggccagcaugauuugguuauccccuccaaugguuauuuuagguuugauuccuggguuaaucaauucuacacacuugcccccaugggaaauggaacggggcguagacguuaa

SEQ ID NO: 8072 - RNA, 1617 nt, Artificial Sequence
  VP1__Norovirus_and/or_Norovirus-like__AB504323
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggcgagauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccaggucacuauguucccccacauaauaauagauguuaggcaauuggaaccuguguugauccccuuaccugauguuaggaauaacuucuaucauuauaaucagucaaaugauucuaccauuaaauugauagcaaugcuguauacaccacuuagggcuaauaaugcuggggaagaugucuucacagucucuugucgaguccucacgaggccaucccuugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggcgccuuuguuguucaaccacaaaauggcagaugcacgacugauggcgugcucuuaggcaccacccaacugucuccugucaacaucugcacccucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaucgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcaacacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguucgauuccuggguuaaucaauucuacacacuugcccccaugggaaauggaacggggcguagacguuaa

SEQ ID NO: 8073 - RNA, 1617 nt, Artificial Sequence
  VP1__Norovirus_and/or_Norovirus-like__KX353963
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguauaaugguuaugcaggugguuucgaagugcagguaauccucgcggggaacgcguucaccgccgggaaaaucauauuugcagcagucccaccaaauuucccaaccgaagguuugagccccagccaagucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgacuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaagacacaaaguucaccccagucgguguuauccaggaugguaguacuaccccccgaaaugaaccccaacaaugggugcucccaaguuacucaggcagaaacauucacaaugugcaccuggcccccgcuguagcccccacuuucccgggcgagcagcuccucuucuucagauccacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8074 - RNA, 1617 nt, Artificial Sequence
  VP1__Norovirus_and/or_Norovirus-like__KR904213
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggucugagccccagccaggucacuauguucccccacauaauaguagauguuaggcaauuggaaccuguguugauccccuuacccgauguuaggaauaauuucuaucauuauaaucaaucaaaugacuccaccaucaaauugauagcaauguuguacacaccacuuagggcuaauaaugccggggacgaugucuucacaguuucuugucgaguucucacgagaccaucccccgauuuugauuuuauauuuuuggugccacccacaguugaaucaagaacuaaaccauucucuguuccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagccacaguguacacugggagcgccgacuuuucuccaaaacuggguagaguucaauuugccacugacacagacaaugauuuugaaacuaaccaaaacacaaaguucaccccagucggcguuauccaggaugguaguacuaccccccgaaaugaaccccaacaaugggugcucccaaguuacucaggcagaaacauucacaaugugcaccuggcccccgcuguagcccccacuuucccgggcgagcagcuccucuuuuucagauccacuaugcccggaugcagcggguaccccaacauggacuuggacugucugcucccccaggaaugggugcaauacuucuaccaggaggcagccccagcacaaucugauguggcucuguuaagauuugugaauccagacacagguaggguucuguuugaguguaagcuucauaaaucaggcuauguuacaguggcucauacuggccaacaugauuugguuaucccccccaaugguuauuuuagauuugauuccugggucaaccaguucuucucccuugcccccaugggaaaugggacggggcgcagacgauaa

SEQ ID NO: 8075 - RNA, 1617 nt, Artificial Sequence
  VP1__Norovirus_and/or_Norovirus-like__AB933745
augaagauggcgucuaaccacgucaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucucacuuggccagaauguacaaugguuaugcaggugguuuugaagugcagguaauccucgcggggaacgcguucaccgccgggaaaaucauauuugcagcagucccaccaaauuucccgacugaagguuugagccccagccaggucacuauguucccccacauaauaguagaugucaggcaauuggaaccuguguugauccccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccaucccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagccccuacuuucccaggcgagcagcuccucuucuucagauccauuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccagcaugauuugguuaucccccccaaugguuauuuuagauuugauuccugggucaaccaguucuacacacuugcccccaugggaaaugggacggggcguagacguuaa

SEQ ID NO: 8076 - RNA, 1617 nt, Artificial Sequence
  VP1__Norovirus_and/or_Norovirus-like__KP096341
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaauggcuaugcaggugguuuugaagugcagguaauucucgcggggaacgcguucaccgccgggaaggucauauuugcagcagucccaccaaauuuuccaacugaaggcuugagccccagccagguuacuauguucccccauauaguaguagauguuaggcaauuagaaccuguguugauucccuuacccgauguuaggaauaauuucuaucauuacaaucaaucaaaugaucccaccauuaaguugauagcaauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugacggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguauauugggggcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 8077 - RNA, 1617 nt, Artificial Sequence
  VP1__Norovirus_and/or_Norovirus-like__KM114291
augaagauggcgucgagugacgccaacccaucugauggguccgcagccaaccucgucccagaggucaauaaugagguuauggcucuggagcccguuguuggugccgccauugcggcaccuguagcgggccaacaaaauguaauugaccccuggauuagaaauaauuuuguaccagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguacacaccacuuagggcuaacaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcgccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccgugauuuugaagcuaaccaaaacacaaaguucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguaggcguuaa

SEQ ID NO: 8078 - RNA, 1617 nt, Artificial Sequence
  VP1__Norovirus_and/or_Norovirus-like__KF060105
augaagauggcgucgagugacgccaacccaucugauggguccacagccaaccucgucccagaggucaacaaugagguuauggcuuuggagcccgugguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggaugaugucuucacaguuucuugucgaguucucacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacugucuccugucaacgucugcaccuucagaggggaugucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacuggguagaguucaauuugccacugacacaaacaaugauuuugaaacuaaccaaaacacaaaauucaccccagucggcguuauccaggaugguagcaccaccccccgaaaugaaccccaacaaugggugcucccaaguuacucagguagaaacauucacaaugugcaccuggcccccgcuguagcccccacuuucccgggcgagcagcuccucuucuucagaucuacuaugcccggaugcagcggguaccccaacauggacuuggauugucugcucccccaggaaugggugcaguauuucuaccaggaggcagccccagcacaaucugauguggcucuguugagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 8079 - RNA, 1617 nt, Artificial Sequence
  VP1__Norovirus_and/or_Norovirus-like__KF060081
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauccccuuacccgauguuaggaauaauuucuaccauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacuaucuccugucaacaucugcaccuucagaggggacgucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacugggcagaguucaguuugccacugacacaaacaaugauuuugaaacuaaccaaaacacaaaauucaccccagucggcguuauccaggaugguaguacuaccccccgaaaugaaccccaacaaugggugcucccaaguuacucaggcagaaacauucacaaugugcaccuggcccccgcuguggcccccacuuucccgggcgaacagcuccucuucuucagaucuacuaugcccggaugcagcggguaccccaacauggauuuggauugucugcucccccaggaaugggugcaguacuucuaccaggaggcagccccagcacaaucugauguggcccuguuaagauuugugaauccagacacagguaggguuuuguuugaguguaagcuucauaaaucaggcuauguuacaguggcucauacuggccagcaugauuugguuaucccccccaaugguuauuuuagauuugacuccugggucaaccaguucuacacacuugcccccaugggaaaugggacggggcguagacguuaa

SEQ ID NO: 8080 - RNA, 1617 nt, Artificial Sequence
  VP1__Norovirus_and/or_Norovirus-like__KF059999
augaagauggcgucgagugacgccaacccaucugauggguccgcagccaaccucgucccagaggucaacaaugagguuauggcucuggagcccguuguuggugccgccauugcggcgccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacaagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaauuccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccaacagugggugcucccaaguuacucaggcagaaacacucauaaugugcaucuggcucccgcuguagcccccacuuuuccgggugagcaacuucucuucuucagauccaccaugcccggaugcagcggguaccccaacauggauuuggacugucugcucccccaggaaugggugcaguacuucuaccaagagacagccccagcacaaucugauguggcucugcuaagauuugugaauccagacacagguaggguuuuguuugaguguaagcuucauaaaucaugcuauguuacaguggcccacacuggccaacaugauuugguuaucccccccaaugguuauuuuagguuugauuccugggucaaccaguuuuacacgcuugcccccaugggaaauggaacggggcguagacguuaa

SEQ ID NO: 8081 - RNA, 1617 nt, Artificial Sequence
  VP1__Norovirus_and/or_Norovirus-like__JX644036
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaguuggagccuguguugauccccuuacccgauguuaggaauaauuucuaccauuauaaucaaucaaaugacuccaccaucaaauugauagcaauguuguauacaccacuuagggcuaauaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguaaugccuuuguuguucaaccccaaaacggcagguguacgacugauggcgugcuccuagguacuacccaauugucuccugucaacaucugcacauucagaggggaugucacccacauuccaggcagucguaacuacacaaugaauuuggccucccaaaacuggaacaguuacgauccaacagaagaaaucccagccccucuaggaacuccagauuuuguggggaaaauccaaggugugcucacccaaaccacaaggacaaauggcucgacccgcggccacaaagcuacaguguacacugggagcgccgacuuuucuccaaaacuggguaggguucaauuugccacugacacagacaaugauuuugaaacuaaccaaaacacaaaguucaccccagucggcguuauccaggaugguagcacuaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaauccgauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 8082 - RNA, 1617 nt, Artificial Sequence
  VP1__Norovirus_and/or_Norovirus-like__JX459654
augaagauggcgucgaaugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaacgcguucaccgccgggaaaauuauauuugcagcagucccaccaaacuucccaacugaaggcuugagccccagccaggucacuauguucccccacauaauaguagauguuagacaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccucgauuuugauuuuauauucuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggaugucauccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaacggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcaggaacauucacaaugugcaccuggcccccgcuguagcccccaccuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugacuccugggucaaccaguucuacacacuugcccccaugggaaaugggacggggcguagacguuaa

SEQ ID NO: 8083 - RNA, 1617 nt, Artificial Sequence
  VP1__Norovirus_and/or_Norovirus-like__JN400621
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaacaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucauaaugugcaccuggcccccgcuguagcccccacuuucccgggcgagcagcuucucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuauguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8084 - RNA, 1617 nt, Artificial Sequence
  VP1__Norovirus_and/or_Norovirus-like__AB541260
augaagauggcgucgaaugacgccaacccaucugauggguccgcagccaaccucgucccagaggucaacaaugagguuauggcuuuggagcccguugucggugcggcuauugcggcgccuguagcggcccaacaaaauguaauugaccccuggauuagaaauaauuuuguacaagccccugguggagaguucacaguaucccccagaaacgcuccaagugaaauacuauggagcgcgccuuuaggcccugaucugaaccccuaccuaucucauuuugccagaauguauaauuguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaauguuguauacaccacuuagggcuaauaaugcuggggaagaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaaccccagauuucgugggaaagauccaaggagugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggauugccugcucccccaggagugggugcagcacuucuaccaagaggcagcuccagcacaaucugauguggcucuauugagauuugugaauccagacacggguaggguccuguuugagugcaagcuucacaaaucaggcuaugucacaguggcucacaccggccagcaugauuuggucaucccccccaaugguuauuuuagguuugauuccuggguuaaucaguucuacacacuugcccccaugggaaauggaacggggcguagacguuaa

SEQ ID NO: 8085 - RNA, 1617 nt, Artificial Sequence
  VP1__Norovirus_and/or_Norovirus-like__KX514341
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuauaaucagucaaaugauucuaccauuaaauugauagcaaugcuguacacaccacuuagggccaauaaugcuggggaugaugucuucacagucuccugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccaaucugggaacacuaaaauuuacacaaugaauuuggccucuccaaauuggaacaauuaugauccaacagaagagauuccagccccucugggaacuccagauuuuguaggaaagauccaagguaugcucacucaaaccacaaagggagaagguucgacccggggccauagagcuacaguauauguugggagugccaacuaugcuccaaagcuagguagaguucaauuugaaacugacacaacugaugaucuugaugcucaccaaaacacaaaauucaccccagucggugucguccagaguggugaaucccccaaaggaagugaaccccaacaaugggugcucccaaguuauucagguagagauacccccaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucauccccccuaauggcuacuuuagguuugauuccuggguuaaucaauucuacacacuugcccccaugggaaauggaacggggcguaagcguuaa

SEQ ID NO: 8086 - RNA, 1617 nt, Artificial Sequence
  VP1__Norovirus_and/or_Norovirus-like__KX514253
augaagauggcgucgaaugacgccaacccaucugauggguccacagccaaccucgucccagaggucaacaaugagguuauggcuuuggagcccguugucggugccgcuaucgcggcaccuguagcgggccaacaaaauguaauugaccccuggauuagaaauaauuuuguacaagccccugguggagaguucacaguauccccuagaaacgcuccaggugaaauucuauggagcgcgcccuuagguccuggucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugaaucccagccaggucacuauguucccccauauaauaguagauguuaggcaauuagaaccuguguugauccccuuaccugauguuaggaauaauuucuaucauuauaaucagucaaaugauucuaccauuaaauugauagcaaugcuguauacaccacuuagggccaauaaugcuggggaugaugucuucacaguuucuugucgaguccucacgaggccauccccugauuuugauuuuauauuccugguaccacccacaguugagucaagaucuaagcccuuuucugucccagucuuaacuguucaagaaaugaccaauucaagauuccccgcuacuuuggauaaauuguucacaggucccagcaguaaucuuguuguccaaccacagaauggcaggugcaugauugauggugugcucuuaggcaccacccaacuguccccugucaacauuugcaccuucagaggggaugucacccaccuuagggacucuacaauuuacacaaugaauuuggccucuccaaauuggaacaauuaugacccaacagaagagauuccagccccucugggaacuccagauuuugugggaaaaauccaaggugugcucacucaaacuacaaagggagaagguucgacccggggccauagagccacaguuuacguugggagugccgacuauacuccaaagcuggguaaaguucaauuugagacuaacacaacuaaugaucuuuaugcucaccaaaacacaaaauucaccccagucggugucguccaggguggugaauccgcccaccgaagugaaccccaacaaugggugcucccagguuauucagguagagacacccccaauguacaucuagccccugcuguagcccccacuuucccaggugaacaacuucuuuucuucagauccacuauacccgggugcggcgggcaccccaacauggauuuggacugccuacucccccaggagugggugcagcacuucuaccaagaggcagcuccagcacaaucugauguggcucuguugagauuugugaauccagacacgaguaggguccuguuugagugcaaacuucauaaaucagguuaugucacaguggcucacaccggucaacaugauuugguaaucccccccaauggcuauuuuagauuugauuccuggguuaaucaauucuacacacuugcccccaugggaaauggaacggggcguaaacguuaa

SEQ ID NO: 8087 - RNA, 1617 nt, Artificial Sequence
  VP1__Norovirus_and/or_Norovirus-like__KX514195
augaagauggcgucgagugacgccaacccaucugauggguccgcagccaaccucgucccagaggucaacaaugagguuauggcuuuggagcccguugucggugccgcuauugcggcgccuguagcgggccaacaaaacguaauugaccccuggauuagaaauaauuuuguucaagccccugguggagaguucaccguaucuccuagaaacgcuccaggugaaauacuauggagcgcgcccuuagguccugaccugaaucccuaccuaucucauuuggccagaauguauaauaguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaauuuggaaagauuauucacgggacccagcaguacccuuguuguucaaccacaaaauggcagaugcaugauugauggcgugcucuuaggcaccacccaacuguccccugucaacauuugcaccuucagaggggaugucacccacucuagggacuccacaauuuacacaaugaauuuggccuccccaaauuggaacaauuaugacccaacagaagagauuccagccccucugggaacuccagauuuugugggaaagauucaaggugugcucacucaaaccacaaagggagaagguucgacccggggccauagagcuacaguuuauguugggagugccaacuacacuccaaagcugggcaaaguucaauuugagacuaacacaacuaaugaucuuuaugcucaccaaaacacaagauucaccccagucggugucguccaggguggugaguccgcccaccgaagugaaccccaacaaugggugcucccaaguuauucagguagagacaccccuaauguacaucuagccccugcuguagcccccacuuucccaggugagcaacuucuuuucuucagauccacuauacccggaugcggcgggcaucccaacauggauuuggauugccuacucccccaggagugggugcaacacuucuaccaagaggcagcuccagcacaaucugauguggcucuauugagauuugugaauccagacacaaguaggguccuguuugagugcaaacuucauaaaucagguuaugucacaguggcucacaccggucaacaugauuugguuaucccccccaauggcuacuuuagauuugauuccugggucaaucaauucuacacacuugcccccaugggaaauggaacggggcguaagcguuaa

SEQ ID NO: 8088 - RNA, 1617 nt, Artificial Sequence
  VP1__Norovirus_and/or_Norovirus-like__KX354016
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuugugcaagccccugguggagaguuuacaguauccccuagaaacgcuccaggugaaauacuguggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaucauuauaaucaaucaaaugauuccaccaucaaauugauagcaauguuguacacaccacuuagggcuaauaaugccggggacgaugucuucacaguuucuugucgaguucuuacgagaccaucccccgauuuugauuucauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugacggcgugcuccuagguaccacucaacugucuccugucaacaucugcaccuucagagggggugucacccauauuccaggcagucauaacuacacaaugaauuuggccucccaaaauuggagcaguuacgauccaacagaagaaaucccagccccucuaggaacuccagauuucguagggaagauucaaggugugcucacucaaaccacaagcacaaauggcucgacccgcggccacaaagcuacaguguacacugggagcgccgacuuuucuccaaaacuggguagaguucaauuugccacugacacaaauaaugauuuugaaacuaaccaaaacacaaaauucaccccagucggcguuauccaggaugguaguacuaccccccgaaaugaaccccaacaaugggugcucccaaguuacucaggcagaaacauucacaaugugcaccuggcccccgcuguagcccccacuuucccgggcgaacagcucuuauucuucagaucuacuaugcccggaugcagcggguaccccaacauggacuuggauugucugcucccccaggaaugggugcaguacuucuaccaagaggcagccccagcacaaucugauguggcucuguuaagauuugugaauccagacacagguagggucuuguuugaguguaagcuucauaaaucaggcuauguuacaguggcucauacuggccaacaugauuugguuaucccccccaauggcuauuuuagauuugauuccugggucaaccaguucuacacacuugcccccaugggaaaugggacggggcguagacguuaa

SEQ ID NO: 8089 - RNA, 1617 nt, Artificial Sequence
  VP1__Norovirus_and/or_Norovirus-like__KM245073
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuaggaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuuuccaacugaagguuugagccccagccaagucacuauguucccccaccuaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuuuacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaaccccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguacuaccccccgaaaugaaccccaacaaugggugcucccaaguuacucaggcagaaacauucacaaugugcaccuggcccccgcuguagcccccacuuucccgggcgagcagcuucucuucuucagaucuacuaugcccggaugcagcggguaccccaacauggacuuggacugucugcucccccaggaaugggugcaguacuucuaccaggaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8090 - RNA, 1617 nt, Artificial Sequence
  VP1__Norovirus_and/or_Norovirus-like__LN854567
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugauuuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauagugguagauguuaggcaacuagaaccuguguugauucccuuacccgauguuaggaauaauuuuuaucauuauaaucaaucaaaugaccccaccauuaaauugauagcaauguuguacacaccacuuagggcuaauaaugcuggggaugaugucuucacaguuucuugccgaguucucacgaggccaucccccgauuuugauuucauauuucuagugccacccacaguugagucaagaaccaaaccauucucugucccaguuuuaacuguugaggaaaugaccaauucaagauuccccauuccuuuggaaaaguuguucacaggucccagcagugacuuuguuguccaaccacaaaacggcaggugcacgacugauggcgugcuccuaggcaccacccaacugucuccugucaauaucuguaccuucagaggagaugucacccauaccacagguagucguaacuacacaaugaauuuggcuucucaaaauuggaacaauuaugacccaacagaagaaaccccagccccucuaggaacuccagacuuuguggggaagauucgaggcaugcucacccaaaccacaagggcagauggcucaacacgcggccacaaagccacaguguacacugggagcgccgacuuugcuccaaaacuggguagaguucaauuugaaacugacacagacaaugauuuugaugcuaaccaaaacacaaaguucaccccagucggugucauccaagaugguaccaccacccaccgaaaugaaccccgacagugggugcucccaaguuacucaggcagaaacacucauaauguacaucuagccccugcuguagcccccacuuuuccgggugagcaacuucucuucuucagauccaccaugcccggaugcagcggguaccccaacauggauuuggacuguuugcucccccaggaaugggugcaguucuucuaccaagaggcagccccagcacaaucugauguggcucugcuaagauuugugaauccagacacagguaggguuuuguuugaguguaagcuucauaaaucaggcuauguuacaguggcucacacuggcccacaugauuugguuauuccccccaaugguuauuucagauuugauuccugggucaaccaguucuacacgcucgcccccaugggaaauggaacggggcguagacguuaa

SEQ ID NO: 8091 - RNA, 1617 nt, Artificial Sequence
  VP1__Norovirus_and/or_Norovirus-like__JN400619
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccuuguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaucauuauaaucaaucaaaugacuccaccaucaaauugauagcaauguuguacacaccacuuagggcuaauaaugccggggacgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguaccacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaaaauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucggcguuauccaggaugguaguacuaccccccgaaaugaaccccaacaaugggugcucccaaguuacucaggcaggaacauucacaaugugcaccuggcccccgcuguagcccccacuuucccgggcgagcagcuccucuuuuucagaucuacuaugcccggaugcaguggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 8092 - RNA, 1617 nt, Artificial Sequence
  VP1__Norovirus_and/or_Norovirus-like__KF060052
augaagauggcgucgagugacgccaacccaucugauggguccacagccaaccucgucccagaggucaacaaugagguuauggcuuuggagcccgugguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauccccuuacccgauguuaggaauaauuucuaucauuauaaucaaucaaaugauuccaccaucaaauugauagcaauguuguacacaccacuuagggcuaauaaugccggggaugaugucuucacaguuucuugucgaguucucacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucagcugucuccugucaacaucugcaccuucagaggggaugucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacuggguagaguucaauuugucacugacacaaacaaugauuuugaaacuaaccaaaacacaaaauucaccccagucggcguuauccaggaugguagcaccaccccccgaaaugaaccccaacaaugggugcucccaaguuacucagguagaaacauucacaaugugcaccuggcccccgcuguagcccccacuuucccgggcgagcagcuccucuucuucagaucuacuaugcccggaugcagcggguaccccaacauggacuuggauugucugcucccccaggaaugggugcaguauuucuaccaggaggcagccccagcacaaucugauguggcucuguugagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 8093 - RNA, 1617 nt, Artificial Sequence
  VP1__Norovirus_and/or_Norovirus-like__KF060014
augaagauggcgucgagugacgccaacccaucugauggguccacagccaaccucgucccagaggucagcaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauccccuuacccgauguuaggaauaauuucuaccauuauaaucaaucaaaugacuccaccaucaaauugauagcaauguuguacacaccacuuagggcuaauagugccggggaugaugucuucacaguuucuugucgaguucuuacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacuaucuccugucaacaucugcaccuucagaggggacgucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacugggcagaguucaguuugccacugacacaaacaaugauuuugaaacuaaccaaaacacaaaauucaccccagucggcguuauccaggaugguaguacuaccccccgaaaugaaccccaacaaugggugcucccaaguuacucaggcagaaacauucacaaugugcaccuggcccccgcuguggcccccacuuucccgggcgaacagcuccucuucuucagaucuacuaugcccggaugcagcggguaccccaacauggauuuggauugucugcucccccaggaaugggugcaguacuucuaccaggaggcagccccagcacaaucugauguggcccuguuaagauuugugaauccagacacagguaggguuuuguuugaguguaagcuucauaaaucaggcuauauuacaguggcucauacuggccagcaugauuugguuaucccccccaaugguuauuuuagauuugacuccugggucaaccaguucuacacacuugcccccaugggaaacgggacggggcguagacguuaa

SEQ ID NO: 8094 - RNA, 1617 nt, Artificial Sequence
  VP1__Norovirus_and/or_Norovirus-like__KC517375
augaagauggcgucgagugacgccaacccaucugauggguccgcagccaaccucgucccagaggucaacaaugagguuauggcucuggagcccguugcuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguaugcaccacuuagggcuaauaaugcuggggaugaugucuucacaguuucuugccgaguucucacgagaccaucccccgauuuugauuuuauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 8095 - RNA, 1617 nt, Artificial Sequence
  VP1__Norovirus_and/or_Norovirus-like__JX644039
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauucucgcggggaacgcguucaccgccgggaaaauuauauuugcagcagucccgccaaauuucccaacugaagguuugagccccagccaggucacuauguucccccacauaauaguagauguuaggcaauuggaaccuguguugauccccuuacccgauguuaggaauaacuucuaucacuauaaucaaucaaaugauucuaccaucaaauugauagcaauguuguauacaccacuuagggcuaauaaugccggggaugacgucuucacaguuucuugucgaguucucacgagaccaucccccgauuuugauuuuauauuuuuggugccacccacaguugaaucaagaacuaaaccauucucugucccaaucuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuucaggcagucguaacuacacaaugaauuuggccucccaaaauuggaccaguuacgauccaacagaagaaaucccagccccucuaggaacuccagauuucguggggaaaauucaaggugugcucacccaaaccacaaggacaaauggcucgacccgcggccacaaagcuacaguguacacugggagcgccgacuuuucuccaaaacuggguagaguucaauuugccacugauacagacaaugauuuugaaacuaaccaaaacacaaaguucaccccagucggcguuauccaggaugguaguacuaccccccgaaaugaaccccaacaaugggugcucccaaguuacucaggcaggaacauucacaaugugcaccuggcccccgcuguagcccccacuuucccgggcgagcagcuccucuuuuucaggucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 8096 - RNA, 1617 nt, Artificial Sequence
  VP1__Norovirus_and/or_Norovirus-like__JX644031
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacgacugauggcgugcuccuagguaccacccaacugucuccugucaacaucugcaccuucagaggggaugucacccacauuccaggcagucguaacuacacaaugaauuuggccucccaaaauuggagcaguuacgauccaacagaagaaaucccagccccucuaggaaccccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauccauaaugugcaccuagcccccgcuguagcccccacuuucccgggcgagcagcuucucuucuucagauccacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8097 - RNA, 1617 nt, Artificial Sequence
  VP1__Norovirus_and/or_Norovirus-like__HM191773
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguucacaguguccccuagaaacgcuccaggugaaauacuauggagcgcgcccuuaggcccugauuugaaucccuaccuuucccauuuguccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagaugucaggcaauuggaaccuguguugauucccuuacccgauguuagaaauaauuucuaccauuauaaucaaucaaaugaccccaccaucaaauugauagcaauguuguacacaccacuuagggcuaauaaugccggggaugacgucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagcagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgagcagcuccucuucuuuagaucuacuaugcccggaugcagcggguaccccaacauggauuuggacugucugcucccccaggaaugggugcaguauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8098 - RNA, 1617 nt, Artificial Sequence
  VP1__Norovirus_and/or_Norovirus-like__AB504309
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccucucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuuuuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuuuuggugccacccacaguugagucaagaaccaaaccauucaccgucccaauuuuaacuguugaggaaaugaccaauucaagauuccccauuccuuuggaaaaauuguucacgggucccaguagugccuuugucguccaaccacaaaauggcaggugcacgacugauggcgugcucuuaggcacuacccaacugucccccgucaacaucugcaccuucagaggggaugucacccacauuccagguacucguacuuacagaaugaauuuggcuucucaaaauuggaacaauuaugacccaacagaagaaaucccagccccucugggaacuccagauuuugugggaaagauccaaggcgugcucacccagaccacaaggggagacggcucgacccgcggucacaaagcuacagugagcacugggagugucgacuucacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuuuccgggugagcaacuucuuuucuucagauuuacuaugcccggaugcaguggguaucccaauauggauuuggauugucuacucccccaggaaugggugcagcacuucuaccaagaggcagcuccagcacaaucugauguggcuuugcugagauuugugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccauggggaauggagcggggcguagacguuaa

SEQ ID NO: 8099 - RNA, 1617 nt, Artificial Sequence
  VP1__Norovirus_and/or_Norovirus-like__KX514216
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccaccuuagggacucuccaauuuacacaaugaauuuggccucuccaaauuggaacaauuaugacucaacagaagagauuccagccccucugggaacuccagauuuugugggaaaaauccaaggugugcucacucaaacuacaaagggagaagguucgacccggggccauagagccacaguuuacguugggagugccaacuauacuccaaagcuggguaaaguucaauuugagacuaacacaacuaaugaucuuuaugcucaccaaaacacaaaauucaccccagucggugucguccaggguggugaauccgcccaccgaagugaaccccaacaaugggugcucccagguuauucagguagagacacccccaauguacaucuagccccugcuguagcccccacuuucccaggugaacaacuucuuuucuucagauccacuauacccgggugcggcgggcaccccaacauggauuuggacugccuacucccccaggagugggugcagcacuucuaccaagaggcagcuccagcacaaucugauguggcucuguugagauuugugaauccagacacgaguaggguccuguuugagugcaaacuucauaaaucagguuaugucacaguggcucacaccggucaacaugauuugguaaucccccccaauggcuauuuuagauuugauuccuggguuaaucaauucuacacacuugcccccaugggaaauggaacggggcguaagcguuaa

SEQ ID NO: 8100 - RNA, 1617 nt, Artificial Sequence
  VP1__Norovirus_and/or_Norovirus-like__KX514212
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaacugaaucccuaccuaucucauuuggcuagaauguauaaugguuaugcaggugguuuugaagugcaggugauccucgcggggaaugcguuuaccgcaggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacaguuucuugucgaguccucacgaggccauccccugauuuugauuuuauauuccugguaccacccacaguugagucaagaucuaagcccuuuucugucccagucuuaacuguucaagaaaugaccaauucaagauuccccgcuacuuuggauaaauuguucacaggucccagcaguaaucuuguuguccaaccacagaauggcaggugcaugauugauggugugcucuuaggcaccacccaacuguccccugucaacauuugcaccuucagaggggaugucacccacccuagggacucuccaauuuacacaaugaauuuggccucuccaaauuggaacaauuaugacccaacagaagagauuccagccccucugggaacuccagauuuugugggaaaaauccaaggugugcucacucaaacuacaaagggagaagguucgacccggggccauagagccacaguuuacguugggagugccaacuauacuccaaagcuggguaaaguucaauuugagacuaacacaacuaaugaucuuuaugcucaccaaaacacaaaauucaccccagucggugucguccaggguggugaauccgcccaccgaagugaaccccaacaaugggugcucccagguuauucagguagagacacccccaauguacaucuagccccugcuguagcccccacuuucccaggugaacaacuucuuuucuucagauccacuauacccgggugcggcgggcaccccaacauggauuuggacugccuacucccccaggagugggugcagcacuucuaccaagaggcagcuccagcacaaucugauguggcucuguugagauuugugaauccagacacgaguaggguccuguuugagugcaaacuucauaaaucagguuaugucacaguggcucacaccggucaacaugauuugguaaucccccccaauggcuauuuuagauuugauuccuggguuaaucaauucuacacacuugcccccaugggaaauggaacggggcgcaagcguuaa

SEQ ID NO: 8101 - RNA, 1617 nt, Artificial Sequence
  VP1__Norovirus_and/or_Norovirus-like__KX354138
augaagauggcgucgagugacgccaacccaucugauggguccgcagccaaccucgucccagaggccaacaaugagguuauggcuuuggagcccguuguuggugccgccauugcggcaccuguagcgggccaacaaaauguaauugaccccuggauuagaaauaauuuuguacaagccccugguggagaguuuacaauauccccuagaaacgcuccaggugaaauacuauggagcgcgcccuugggaccugaucugaaucccuaccuaucccauuuggccagaauguacaaugguuaugcaggugguuuugaagugcagguaauucucgcggggaacgcguucaccgccgggaaggucauauuugcagcagucccaccaaauuuuccaacugcaggcuugagccccagccaggucacuauguuccccaguauaguaguggauguuaggcaacuagaaccuguguugauucccuuacccgauguuaggaauaacuuuuaccauuauaaucaaucaaaugaccccaccauuacuuugauagcaauguuguauacuccacucagggcuaacaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaggcuguucacgggccccagcagugccuuuguuguucaaccacaaaacggcaggugcacgacugauggcgugcuccuaggcacuacccaacugucuccugucaacauuugcaccuucagaggagauaucacccauaucacagguagucauaacuacacaaugaauuuggcuucucaaaauuggaacaauuaugacccaacagaagaaaucccagccccccuaggaacuccagacuuuguagggaagauucaaggcgugcucacccaaaccacaaggggggauggcucaacacgcggccacaaagccacaguguacacugggagcgccgauuuuucuccaaaacuggguagaguccaauuugaaacugacacaaaccaugauuuugaagcuaaccaaaacacaaaguucaccccagucggugucauccaagaugguagcaccacccaccgaaaugaaccccaacagugggugcucccaaguuacucaggcagaaacacucauaaugugcaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaagcuucauaaaucaggcuacauuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 8102 - RNA, 1617 nt, Artificial Sequence
  VP1__Norovirus_and/or_Norovirus-like__AB933747
augaagauggcgucgagugacgccaacccauuugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuguccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauucccuuacccgauguuagaaauaauuucuaccauuauaaucaaucaaaugaccccaccaucaaauugauagcaauguuguauacaccacuuagggcuaauaaugccggggaugaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccguggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuauucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucuuuuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8103 - RNA, 1617 nt, Artificial Sequence
  VP1__Norovirus_and/or_Norovirus-like__KJ955493
augaagauggcgucgagugacgccaacccaucugauggguccgcagccaaccucgucccagaggucaacaaugagguuauggcucuggagccguuuguuggugccgccauugcggcaccuguagcgggccaacaaaauguaauugaccccuggaucagaaauaauuuuguacaagccccugguggagaguuuacaguauccccuagaaacgcuccaggugaaauacuauggagcgcgcccuugggcccugaucuaaaucccuaccuaucccaucuggccagaauguacaaugguuaugcaggugguuuugaagugcaaguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugaccuaacagaagaaaucccagccccucuaggaacuccagauuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaagugaaccccaacagugggugcucccaaguuacucaggcagaaacacucccaaugugcaucuggcccccgcuguagcccccacuuuuccgggugagcaacuucucuucuucagauccaccaugcccggauguagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuaugucacaguggcucacacuggccaacaugauuuggucaucccccccaaugguuauuuuagguuugauuccugggucaaccaguuuuacacgcuugcccccaugggaaauggaacggggcguagacguuaa

SEQ ID NO: 8104 - RNA, 1617 nt, Artificial Sequence
  VP1__Norovirus_and/or_Norovirus-like__KJ678153
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuuaaaucccuaccuaucccauuuggccagaauguacaaugguuaugcaggugguuuugaagugcaggugauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguucaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuucguggggaagauucaaggcgugcucacccaaaccacaaggacagauggcucaacacgcggccacaaagccacaguguacauugggagcgccgacuuugcuccaaaacugggcagaguucaauuugaaacugacacagaccaugauuuugaaacuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccuugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 8105 - RNA, 1617 nt, Artificial Sequence
  VP1__Norovirus_and/or_Norovirus-like__KC456071
augaagauggcgucaagugacgccaacccaccugauggguccgcagccaaccucgucccaaaggucaauaaugagguuauggcucuggagcccguuguuggugccgccauugcggcaccuguagcgggccaacaaaauguaauugaccccuggauuaaaaauaauuuuguacaagccccugguggagaguuuacaguauccccuaaaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauuccccuacccgauguuaggaauaacuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacaaaaccauucucugucccaguuuuaacuguugaggagaugaccaauucaagauuccccauucccuuggaaaaguuguucacgggucccagcagugccuuuguuguccaaccacaaaacggcaggugcacgacugauggcgugcuucuaggcaccacccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguagcaccacccaccgaaaugaaccucaacagugggugcucccaaguuacucaggcagagauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacgguaa

SEQ ID NO: 8106 - RNA, 1617 nt, Artificial Sequence
  VP1__Norovirus_and/or_Norovirus-like__KC175384
augaagauggcgucgagugacgccaacccaucugauggguccacagccaaccuugucccagaggucaauaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauucccuuacccgauguuaggaauaauuucuaccauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucucccgucaacaucugcaccuucagaggggacgucacccauauuccaggcagucguaacuacacaaugaauuuggccucccaaaauugggacaguuacgauccaacagaagaaaccccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguagcaccaccccccgaaaugaaccccaacaaugggugcucccaaguuacucaggcagaaacauucauaaugugcaccuggcccccgcuguagcccccacuuucccgggcgagcagcuccucuucuucagaucuacuaugcccggaugcagcggguaccccaacauggacuuggacugccugcucccccaggaaugggugcaauauuucuaccaggaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8107 - RNA, 1617 nt, Artificial Sequence
  VP1__Norovirus_and/or_Norovirus-like__JQ613561
augaagauggcgucgagugacgccaacccaucugauggguccacagccaaccucgucccagaggucaacacugagguuauggcuuuggagcccguaguuggugccgccauugcggcacccguagcgggccaacaaaauguaauugaccccuggauuagaaacaauuuuguacaagccccugguggagaguuuacaguauccccuagaaacgcuccaggugaaauauuauggagcgcgccccuaggcccugaucugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauauaauaguagauguuaggcaauuggaaccuguguugauccccuuacccgauguuaggaauaauuucuaccauuacaaucaaucaaaugacccuaccaucaaauugauagcaauguuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccagcagugccuuuguuguucaaccacaaaauggcaggugcacgacugauggcgugcuccuagguacuacccaacuguccccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuauucaggcaggaacauucauaaugugcaccuggcccccgcuguagcccccacuuucccgggcgagcagcuccucuucuucagaucuacuaugcccggaugcagcggguaccccaacauggauuuggacugucugcucccccaggaauggguacaguacuucuaccaggaggcagccccagcacaaucugaugcggcucuguuaagauuugugaauccagacacagguaggguuuuguuugaguguaagcuucauaaaucaggcuaugucacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8108 - RNA, 1617 nt, Artificial Sequence
  VP1__Norovirus_and/or_Norovirus-like__KJ678145
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguucaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuucguggggaagauucaaggcgugcucacccaaaccacaaggacagauggcucaacacgcggccacaaagccacaguguacacugggagcgccgacuuugcuccaaaacugggcagaguucaauuugaaacugacacagaccaugauuuugaaacuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugaauccugggucaaccaguuuuacacgcuugcccccaugggaaauggaacggggcguagacguuaa

SEQ ID NO: 8109 - RNA, 1617 nt, Artificial Sequence
  VP1__Norovirus_and/or_Norovirus-like__KF060116
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugacuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagaugucaggcaauuggaaccuguguugauccccuuacccgauguuaggaauaauuucuaccauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacuaucuccugucaacaucugcaccuucagaggggacgucacccauauuccaggcagucauaacuacacaaugaauuuggccucccaaaauuggaacaguuacgauccaacagaagaaaccccagccccucuaggaacuccagauuucguggggaagauucaaggugugcucacucaaaccacuaguacaaauggcucgacccgcggccacaaagcuacaguguacacugggagcgccgacuuuucuccaaaacugggcagaguucaguuugccacugacacaaacaaugauuuugaaacuaaccaaaacacaaaauucaccccagucggcguuauccaggaugguaguacuaccccccgaaaugaaccccaacaaugggugcucccaaguuacucaggcagaaacauucacaaugugcaccuggcccccgcuguggcccccacuuucccgggcgaacagcuccucuucuucagaucuacuaugcccggaugcagcggguaccccaacauggauuuggauugucugcucccccaggaaugggugcaguacuucuaccaggaggcagccccagcacaaucugauguggcccuguuaagauuugugaauccagacacagguaggguuuuguuugaguguaagcuucauaaaucaggcuauguuacaguggcucauacuggccagcaugauuugguuaucccccccaaugguuauuuuagauuugacuccugggucaaccaguucuacacacuugcccccaugggaaaugggacggggcguagacguuaa

SEQ ID NO: 8110 - RNA, 1617 nt, Artificial Sequence
  VP1__Norovirus_and/or_Norovirus-like__KC517362
augaagauggcgucgagugacgccaacccaucugauggguccgcagccaaccucgucccagaggucaacaaugagguuauagcucuggagcccguuguuggugccgccauugcggcaccuguggcgggccaacaaaauguaauugaccccuggauuagaaauaauuuuguacaggccccugguggagaguuuacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuucccauuccuuuggaaaaguuguucacgggucccagcagugccuuuguuguccaaccacaaaacggcaggugcacgaccgauggcgugcuccuaggcaccacccaacugucuccugucaacaucugcaccuucagaggagauaucgcccauaucacagguagucguaacuacacaaugaauuuggcuucucaaaauuggaacaauuaugacccaacagaagaaaucccagccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccagucggugucauccaagaugguggcaccacccaccgaaaugaaccccagcagugggugcucccaaguuacucaggcagaaacacucauaaugugcaucuggcccccgcuguagcccccacuuuuccgggugagcaacuucucuucuucagguccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaaccuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 8111 - RNA, 1617 nt, Artificial Sequence
  VP1__Norovirus_and/or_Norovirus-like__JX644038
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucccauuuggccagaauguacaaugguuaugcaggugguuuugaagugcagguaauucucgcggggaacgcguucaccgccgggaaaauuauauuugcagcagucccgccaaauuucccaacugaagguuugagccccagccaggucacuauguucccccacauaauaguagauguuaggcaauuggaaccuguguugauccccuuacccgauguuaggaauaacuucuaucacuauaaucaaucaaaugauucuaccaucaaauugauagcaauguuguauacaccacuuagggcuaauaaugccggggaugacgucuucacaguuucuugucgaguucucacgagaccaucccccgauuuugauuuuauauuuuuggugccacccacaguugaaucaagaacuaaaccauucucugucccaaucuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacgucugcaccuucagaggggaugucacccauauuucaggcagucguaacuacacaaugaauuuggccucccaaaauuggaccaguuacgauccaacagaagaaaucccagccccucuaggaacuccagauuucguggggaaaauucaaggugugcucacccaaaccacaaggacaaauggcucgacccgcggccacaaagcuacaguguacacugggagcgccgacuuuucuccaaaacuggguagaguucaauuugccacugauacagacaaugauuuugaaacuaaccaaaacacaaaguucaccccagucggcguuauccaggaugguaguacuaccccccgaaaugaaccccaacaaugggugcucccaaguuacucaggcaggaacauucacaaugugcaccuggcccccgcuguagcccccacuuucccgggcgagcagcuccucuuuuucaggucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 8112 - RNA, 1617 nt, Artificial Sequence
  VP1__Norovirus_and/or_Norovirus-like__AB504313
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccucucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuuuuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuuuuggugccacccacaguugagucaagaaccaaaccauucaccgucccaauuuuaacuguugaggaaaugaccaauucaagauuccccauuccuuuggaaaaauuguucacgggucccaguagugccuuugucguccaaccacaaaauggcaggugcacgacugauggcgugcucuuaggcacuacccaacugucccccgucaacaucugcaccuucagaggggaugucacccacauuccagguacucguacuuacagaaugaauuuggcuucucaaaauuggaacaauuaugacccaacagaagaaaucccagccccucugggaacuccagauuuugugggaaagauccaaggcaugcucacccagaccacaaggggagacggcuugacccgcggucacaaagcuacagugagcacugggagugucgacuucacuccaaagcugggcagcguucaguucgccacugauacagacaaugacuuugaaacuggccaaaacacaagguucaccccagucggugucauccaggaugguaguagugcccacagaaaugaaccccaacaaugggugcucccagauuacucagguagaacuguucauaauguacaccuagccccugccguagcccccacuuuuccgggcgagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauuuguggauccagacacagguaggguucuguuugagugcaagcuucauaaaacaggcuaugucacaguggcucacacuggccagcaugauuugguuaucccccccaauggcuacuuuagauuugauuccugggucaaccaguucuacacacuugcccccaugggaaauggagcggggcguagacguuaa

SEQ ID NO: 8113 - RNA, 1617 nt, Artificial Sequence
  VP1__Norovirus_and/or_Norovirus-like__KX514361
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuugugcaagccccugguggagaguucacaguauccccuagaaacgcuccaggugaaauacuauggagcgcgcccuuggguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuaaaauuuacacaaugaauuuggccucuccaaauuggaacaauuaugacccaacagaagagaucccagccccucugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacugacacaacugaugaucuugaugcucaccaaaacacaaaauucaccccagucggugucguccaggguggugaaucccccaaaggaagugaaccccaacaaugggugcucccaaguuauucagguaaagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccucccaauggcuacuuuagguuugauuccuggguuaaucaauucuacacacuugcccccaugggaaauggaacggggcguaagcguuaa

SEQ ID NO: 8114 - RNA, 1617 nt, Artificial Sequence
  VP1__Norovirus_and/or_Norovirus-like__KX514336
augaagauggcgucgaaugacgccaacccaucugauggguccgcagccaaccucgucccagaggucaacaaugagguuauggcuuuagagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacucugggaacucuaaaauuuacacaaugaauuuggccucuccaaauuggaacaauuaugacccaacagaagagaucccagccccucugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacugacacaacugaugaucuugaugcucaccaaaacacaaaauucaccccagucggugucguccaggguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccucccaauggcuacuuuagguuugauuccuggguuaaucaauucuacacacuugcccccaugggaaauggaacggggcguaagcguuaa

SEQ ID NO: 8115 - RNA, 1617 nt, Artificial Sequence
  VP1__Norovirus_and/or_Norovirus-like__KX514203
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaacccuggggaugaugucuucacagucuccugucgaguccucacgaggccauccccugauuuugacuuuauauuucuggugccacccacaguugagucaagaucuaagcccuuuucugucccagucuuaacuguucaagaaaugaccaauucaagauuccccgcuacuuuggauaaauuguucacaggucccagcaguacccuuguuguucaaccacaaaauggcagaugcaugauugauggcgugcucuuaggcaccacccaacuguccccugucaacauuugcaccuucagaggggaugucacccacucuagggacuccacaauuuacacaaugaauuuggccuccccaaauuggaacaauuaugacccaacagaagagauuccagccccucugggaacuccagauuuugugggaaagauucaaggugugcucacucaaaccacaaagggagaagguucgacccggggccauagagcuacaguuuauguugggagugccaacuacacuccaaagcugggcaaaguucaauuugagacuaacacaacuaaugaucuuuaugcucaccaaaacacaagauucaccccagucggugucguccaggguggugaguccgcccaccgaagugaaccccaacaaugggugcucccaaguuauucagguagagacaccccuaauguacaucuagccccugcuguagcccccacuuucccaggugagcaacuucuuuucuucagauccacuauacccggaugcggcgggcaucccaacauggauuuggauugccuacucccccaggagugggugcaacacuucuaccaagaggcagcuccagcacaaucugauguggcucuauugagauuugugaauccagacacaaguaggguccuguuugagugcaaacuucauaaaucagguuaugucacaguggcucacaccggucaacaugauuugguuaucccccccaauggcuacuuuagauuugauuccugggucaaucaauucuacacacuugcccccaugggaaauggaacggggcguaagcguuaa

SEQ ID NO: 8116 - RNA, 1617 nt, Artificial Sequence
  VP1__Norovirus_and/or_Norovirus-like__KP784693
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuuguacaagccccugguggagaguuuacaguauccccuagaaacgcuccaggugaaauacucuggagcgcgcccuugggcccugauuugaaccccuaccuuucccauuuggccagaauguacaaugguuaugcaggugguuuugaagugcagguaauccucgcggggaaugcguucaccgccgggaaaaucauauuugcagcagucccaccaaauuucccaacugaagguuugagccccagccaagucacuauguucccccacauaauaguagauguuaggcaauuagaaccuguguugauccccuuacccgauguuaggaauaauuucuaccauuauaaucagucaaaugacuccaccaucaaauugauagcaauguuguacacaccacuuagggcuaacaaugccggggacgacgucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggucccaguagugccuuuguuguucaaccacaaaacggcaggugcacgacugagggcgugcuccuagguacuacccaacugucuccugucaacaucugcaccuucagaggggaugucacccacauuucaggcagucguaacuacacaaugaauuuggccucccaaaauuggaacaguuacgauccaacagaagaaaucccagccccccuaggaacuccagauuucguggggaagauucaaggugugcucacccagaccacaaggacagauggcucgacccgcggccacaaagcuacaguguacacugggagcgccgacuuuucuccaaaacuggguaggguucaauuugccacugacacagacaaugauuuugugacuaaucaaaacacaaaguucaccccagucgguguuauccaggaugguaguacuaccccccgaaaugaaccccaacaaugggugcucccaaguuacucagguagaaacacucauaaugugcaccuggcccccgcuguagcccccacuuucccgggcgagcagcuccucuucuucagaucuaccaugcccggaugcagcggguaccccaacauggauuuggacugucugcucccccaggaaugggugcaguauuucuaccaggaggcagccccagcacaaucugauguggcacuauuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaauggggcggggcguagacguuaa

SEQ ID NO: 8117 - RNA, 1617 nt, Artificial Sequence
  VP1__Norovirus_and/or_Norovirus-like__AB933734
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguauaaugguuaugcaggugguuuugaagugcagguaauccucgcggggaacgcguucaccgccgggaaaaucauauuugcagcagucccaccaaauuucccaacugaaggucugagccccagccaggucacuauguucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggacgaugucuucacaguuucuugucgaguucucacgagaccaucccccgauuuugauuucauauuuuuggugccacccacaguugagucagagacuaaaccauucuuuuucccagucuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaaugguucgacccgcggccacaaagcuacaguguacacugggagcgccgacuuuucuccaaaacuggguagaguccaauuugccacugacacagacaaugauuuugaaacuaaccaaaacacaaaguucaccccagucgguguuauccaggaugguaguacuaccccccgaaaugaaccccaacaaugggugcuuccaaguuacucaggcagaaacauucauaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugagugcaagcuucauaaaucaggcuauguuacaguggcucacacuggccaacaugauuugguuaucccccccaaugguuauuuuagauuugauuccuggguuaaccaguucuacacacuugcccccaugggaaaugggacggggcguagacguuaa

SEQ ID NO: 8118 - RNA, 1617 nt, Artificial Sequence
  VP1__Norovirus_and/or_Norovirus-like__KF060041
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuugggcccugaucuaaaucccuaccuaucccauuuggccagaauguacaaugguuaugcaggugguuuuggagugcagguaauucucgcggggaacgcguucaccgccgggaaggucauauuugcagcagucccaccaaauuuuccaacugaaggcuugagccccagccaggucacuauguucccccauauaguaguaaauguuaggcaacuagaaccuguguugauucccuuacccgauguuaggaauaauuucuaucauuauaaucaaucaaaugaccccaccauuaaauugauagcuauguuguacacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccgacagaagaaaccccagccccucuaggaacuccagacuuuguggggaagauucaaggcgugcucacccaaaccacaaggacagauggcucaacacgcggccacaaagccacaguguacacugggagcgccgacuuugcuccaaaacuggguagaguucaauuugaaacugacacagaccaugauuuugaagcuaaccaaaacacaaaguucaccccagucggugucauccaagaugguaguaccacccaucgaaaugaaccccaacagugggugcucccaaguuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucuuacuggccaacaugauuugguuauuccccccaaugguuauuuuagauuugacuccugggucaaccaguucuacacgcuugcccccaugggaaauggaacggggcguagacguuaa

SEQ ID NO: 8119 - RNA, 1617 nt, Artificial Sequence
  VP1__Norovirus_and/or_Norovirus-like__JX989074
augaagauggcgucgagugacgccaacccaucugauggguccacagccaaccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaacuucuaccauuauaaucaaucaaaugacuccaccaucaaguugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacaggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaccccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaguuugccacugacacagacaaugauuuugaaacuaaccaaaacacaaaguucaccccagucgguguuauccaggaugguaguacuaccccccgaaaugaaccccaacaaugggugcucccaaguuacucaggcagaaauauucauaaugugcaccuggcccccgcuguagcccccacuuucccgggcgagcagcuucucuucuuuagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8120 - RNA, 1617 nt, Artificial Sequence
  VP1__Norovirus_and/or_Norovirus-like__JN400624
augaagauggcgucgagugacgccaacccaucugauggguccacagccaaccuugucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccacauaauaguagauguuaggcaauuggaaccuguguugauucccuuacccgauguuaggaauaauuucuaucauuauaaucaaucaaaugaccccaccaucaaauugauagcaauguuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacgacaggugcacgacugauggcgugcuccuagguacuacccaacugucucccgucaacaucugcaccuucagaggggaugucacccauauuccaggcagucguaacuacacaaugaaucuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucacaguguacaccuggcccccgcuguagcccccacuuucccgggcgagcagcuccucuucuucagaucuacuaugcccggaugcagcggguaccccaacauggacuuggacugucugcucccccaggaaugggugcaguauuucuaccaggaggcagccccagcacaaucugauguggcucugcuaagguuugugaauccggacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8121 - RNA, 1617 nt, Artificial Sequence
  VP1__Norovirus_and/or_Norovirus-like__EU876894
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugacccccggauuagaaauaauuuuguacaagccccugguggagaguuuacaguauccccuagaaacgcuccaggugaaauacuauggagcgcgcccuugggcccugaucugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaagguuugagccccagccaggucacuauguucccccauauaauaguagauguuaggcaacuggaaccuguguugauccccuuacccgauguuaggaauaauuucuaucacuacaaucaaucaaaugaccccaccaucaaauugauagcaauguuguauacaccacuuagggcuaauaaugcuggggacgaugucuucacaguuucuuguuggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugacccaacagaagaaaucccagccccucugggaacuccagauuucguggguaagauccaaggcgugcucacccaaaccacaaggagugauggcucgacccgcggucacaaagccacagugagcacuggaaguguccacuucaccccaaagcugggcagaauucaauucuccacugauacaagcaaugauuuugaaacuggccaaaacacgagauucaccccagucgguguuguccaggaugguaguaccacccaccaaaaugaaccccaacaauggguacucccaaauuacucagguagagauagucacaaugugcaccuagccccugccguggcccccucuuuuccgggugagcaacuucuuuucuucagguccacuaugcccggaugcaguggguaucccaacaugaauuuggauugccuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagauuugauuccugggucaaccaguucuauacacuugcccccaugggaaauggaacggggcguagacguuaa

SEQ ID NO: 8122 - RNA, 1617 nt, Artificial Sequence
  VP1__Norovirus_and/or_Norovirus-like__KX514173
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggacaacucgucauuggacaaugaauuuggccucuccaaauuggaacaauuaugacccaacagaagaaacuccagccccccugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacugacacaacuaaugaucuugaugcucaccaaaacacaaaauucaccccagucggugucguccaggguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguagacguuaa

SEQ ID NO: 8123 - RNA, 1617 nt, Artificial Sequence
  VP1__Norovirus_and/or_Norovirus-like__KX353989
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauggucccccacauaauaguagauguuaggcaauuggaaccuguguugauccccuuacccgauguuaggaauaauuucuaccauuauaaucaaucaaaugauuccaccaucaaauugauagcaauguuguacacaccacuuagggcuaauaaugccggggaugaugucuucacaguuucuugucgaguucuuacgagaccaucccccgauuuugauuuuauauuuuuggugccacccacaguugaaucaagaacuaaaccauucucugucccaauuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacugucuccugucaacaucugcaccuucagaggggaugucacccauauuccaggcagucauaacuacacaaugaauuuggccucccaaaauuggaacaguuacgauccaacagaagaaaucccagccccucuaggaacuccagauuucguggggaagauucaaggugugcucacucaaaccacuaguacaaauggcucgacccgcggccacaaagcuacaguguacacugggagcgccgacuuuucuccaaaacugggaagaguucaauuugccacugacacaaacaaugauuuugaaacuaaccaaaacacaaaauucaccccagucggcguuauccaggaugguaguaccaccccccgaaaugaaccccaacaaugggugcucccaaguuacucagguagaaacauucacaaugugcaccuggcccccgcuguagcccccacuuucccgggcgagcagcuccucuucuucagaucuaccaugcccggaugcagcggguaccccaacauggacuuggauugucugcucccccaggaaugggugcaguacuucuaccaggaggcagccccagcacaaucugauguggcucuguugagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 8124 - RNA, 1617 nt, Artificial Sequence
  VP1__Norovirus_and/or_Norovirus-like__KX353962
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuucccauuuggccagaauguauaaugguuaugcaggugguuucgaagugcagguaauccucgcggggaacgcguucaccgccgggaaaaucauauuugcagcagucccaccaaauuucccaaccgaagguuugagccccagccaagucacuauguucccccacauaauaguagauguuaggcaauuggaaccuguguugauccccuuacccgauguuaggaauaauuucuaccauuauaaucaaucaaaugacuccaccaucaaauugauagcaauguuguacacaccacuuagggcuaauaaugccggggacgaugucuucacaguuucuugucgaguucucacgagaccaucccccgacuuugauuucauauuuuuggugccacccacaguugaaucaagaacuaaaccauucucugucccaguuuuaacuguugaggagaugaccaauccaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaagacacaaaguucaccccagucgguguuauccaggaugguaguacuaccccccgaaaugaaccccaacaaugggugcucccaaguuacucaggcagaaacauucacaaugugcaccuggcccccgcuguagcccccacuuucccgggcgagcagcuccucuucuucagauccacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8125 - RNA, 1617 nt, Artificial Sequence
  VP1__Norovirus_and/or_Norovirus-like__AB972515
augaagauggcgucgagugacgccaacccaucugauggguccacagccaaccuugucccagaggucaacaaugagguuauggcuuuggagcccguaauuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugaucugaaucccuaccuuucucauuuguccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccauaugauaguagaugucaggcaauuggaaccuguguugauucccuuacccgauguuagaaauaauuucuaucauuauaaucaaucaaaugauuccaccaucaaauugauagcaauguuguacacaccacuuagggcuaauaaugccggggaugaugucuucacaguuucuugucgaguucucacgagaccaucccccgauuuugauuucauauuuuuggugccacccacaguugaaucaagaacuaaaccuuucucugucccaguuuuaacuguugaggagaugaccaauucaagguuccccauuccuuuggaaaaguuguucacgggucccaguagugccuuuguuguucaaccacaaaacggcaggugcacaacugauggcgugcuccuagguacuacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccguggccacaaagcuacaguguacacugggagcgccgacuucucuccaaaacuggguagaguucaauuugccacugacacagacaaugauuuugaaacuaaccaaaacacaaaguucaccccagucgguguuauccaggaugguaguaccaccccccgaaaugagccccaacaaugggugcucccaaguuauucaggcagaaacauucauaaugugcaccuggcccccgcuguagcccccacuuucccgggcgagcagcuccuuuucuucagaucuacuaugcccggaugcagcggguaccccaacauggacuuggacugucugcucccccaggaaugggugcaguauuucuaccaggaggcagccccagcacaaucugauguggcucuguuaagauuugugaauccggacacagguaggguuuuguuugaguguaagcuccauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8126 - RNA, 1617 nt, Artificial Sequence
  VP1__Norovirus_and/or_Norovirus-like__KT033904
augaagauggcgucaaaugacgccaacccaucugauggguccgcagccaaccucgucccaaaggucaacaaugagguuauggcuuuggagcccguugucggugccgcuauugcggcgccuguagcgggccaacaaaauguaauugaccccuggauuaaaaacaauuuuguacaagccccugguggaaaguucacaguauccccuaaaaaugcuccaggugaaauacuauggagcgcgcccuugggcccugaucugaaucccuaccuaucucauuuggccagaauguacaagggacaugcgggcgguuuugaagugcaggugauucucgcggggaacgcguucaccgccgggaaaauuauauuugcagcagucccaccaaauuuuccaacugaaggcuugagucccagccaggucaccauguucccccacauaauaguggauguuaggcaauuggaaccuguguugauccccuuaccugauguuaggaauaauuucuaucauuauaaucagucaaaugauucuaccauuaaauugauagcaaugcuguauacaccacuuagggcuaauaaugcuggggaagaugucuuuacagucucuugucgaguucucacgaggccauccccugauuuugauuucauauuuuuggugccaccuacaguugagucaagaacuaaaccauuuacugucccaaucuuaacuguugaagaaaugaccaacucaagauuccccaucccuuuggaaaaguuguucacgggucccagcagugccuuuguuguucaaccacaaaauggcagaugcacgacugauggcgugcucuuaggcacuacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuucacuccaaagcugggcaguguccaauucaguacugacacagaaaaugauuuugaaacucaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaagagugggugcagcacuucuaccaagaggcagcuccagcacaaucugauguggcucuauugagauuugugaauccagacacggguaggguccuguuugagugcaaacuucacaaaucaggcuaugucacaguggcucacaccggccagcaugauuuggucaucccccccaaugguuauuuuagguuugauuccuggguuaaucaauucuacacgcuugcccccaugggaaauggaacggggcguagacguuaa

SEQ ID NO: 8127 - RNA, 1617 nt, Artificial Sequence
  VP1__Norovirus_and/or_Norovirus-like__KM982942
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacgguuucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacaacugauggcgugcuccuaggcaccacccaacugucucccgucaacaucugcaccuucagaggagaugucacccauaucacagguagucauaacuacacaaugaauuuggcuucucaaaauuggagcaauuacgacccaacagaagaaaucccagccccucuaggaacuccagacuuuguggggaagauucaaggcgugcucacccaaaccacaaggacagauggcucaacacgcggccacaaagccacaguguacauugggagcgccgacuuugcuccaaaacugggcagaguucaauuugaaacugacacaaaccaugauuuugaagcuaaccaaaacacaaaguucaccccaguuggugucauccaagaugguggcaccacccaccgaaaugaaccccaacagugggugcucccaaguuacucaggcagaaauacuccuaaugugcaucuggcccccgcuguagcccccacuuuuccgggcgagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaauguaagcuucauaaaucaggcuauguuacaguggcucacaccggccaacaugauuugguuaucccccccaaugguuauuuuagguuugauuccagggucaaccaguuuuacacgcuugcccccaugggaaauggaacggggcguagacguuaa

SEQ ID NO: 8128 - RNA, 1617 nt, Artificial Sequence
  VP1__Norovirus_and/or_Norovirus-like__KJ685417
augaagauggcgucgagugacgccaacccaucugauggguccacagccaaccucgucccagaggucaacaaugagguuauggcuuuggagcccguaguuggugccgcuauugcggcaccuguagcgggccagcaaaauguaauugaccccuggauuagaaacaauuuugugcaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaaugcguucaccgccgggaaaaucauauuugcagcagucccacccaauuucccaacugaagguuugagccccagccaagucacuauguucccccacauaauaguagauguuaggcaauuggaaccuguguugauccccuuacccgauguuaggaauaauuucuaucauuauaaucagucaaaugacuccaccaucaaauugauagcaauguuguacacaccacuuagggcuaacaaugccggggacgaugucuucacaguuucuugucgaguccucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacugucuccugucaacaucugcaccuucagaggugaugucauccacauuucaggcagucguaacuacacaaugaauuuggccucccaaaauuggaacaguuacgauccaacagaagaaaucccagccccccuaggaacuccagauuucguggggaagauucaaggugugcucacccaaaccacaaggacagauggcucgacccgcggccacaaagcuacaguguacacugggagcgccgacuuuucuccaaaacuggguaggguucaauuugccacugacacagacaaugauuuuguaacuaaucaaaacacaaaguucaccccagucgguguuauccaggaugguagcacuaccccccgaaaugaaccccaacaaugggugcucccaaguuacucaggcagaaacacucauaaugugcaccuggcccccgcuguagcccccacuuucccgggcgagcagcuccucuucuucagauccaccaugcccggaugcagcggguaccccaacauggauuuggacugucugcucccccaggaaugggugcaguauuucuaccaggaggcagcuccagcacaaucugauguggcacuguuaagauuugugaauccagacacagguaggguuuuguuugaguguaagcuucauaaaucaggcuauguuacaguggcucacacuggccaacaugauuuaguuaucccccccaaugguuauuuuagauuugauuccugggucaaccaguucuacacacuugcccccaugggaaaugggacggggcguagacguuaa

SEQ ID NO: 8129 - RNA, 1617 nt, Artificial Sequence
  VP1__Norovirus_and/or_Norovirus-like__KC907392
augaagauggccucuaaugacgcuacaccaucugacggcucuacagccaaccuugucccagaagugaauaacgaggucauggcacuugaaccugugguaggggcugcaaucgcagccccuguggcugggcaacaaaacguuauugauccuuggauaaggaauaauuuuguucaggcaccuggaggggaguuuacuguaaguccuaggaacgcuccuggggagauucuuuggucagccccuuugggaccugaucuuaauccuuaucuuucacaccuugccagaauguauaaugguuacgcuggcggguuugaggugcaaguaauuuuggccggaaacgccuuuacagcaggcaagauuaucuucgcugcuguuccuccuaacuuuccaaccgaaggacuuaguccuucucaaguuaccauguuuccucacaucaucguggauguaaggcagcuugagccaguauugaucccucuuccugacguuagaaacaacuucuaucacuacaaucaaucuaaugacccuacuaucaaguugauagcuauguuguacacuccucuuagagcuaacaaugcuggugacgaugucuucacuguuucuugcagagugcuuacaaggccuucaccugauuuugauuucauuuuccuugugccaccaacagucgaaucaaggaccaaaccauuuucuguuccuauuuugaccguggaggaaaugacaaauaguaggucuccuauuccauuggagaagcuuuucacuggaccuucaucugcuuucguggugcaaccucagaauggcagaugcacuacagauggaguauuguuggguacuacucaacuuaguccuguuaacauuuguacauucagaggcgauguagcucauauagcaggaacucagaacuauacuaugaaccuugcaucucagaauuggaauaacuacgacccaaccgaggagaucccagcaccuuuggguaccccuaauuuuguuggcaagauucaggguguucuuacccagaccacuaaaagagaugguucaacuagagguaggaaagcaacaguuucuacuggaucugugcacuuuaccccuaaguuggguucuguucaguuuucuaccgauacaucuaacgacuuugaaacuggucaaaauacuagguuuacaccaguuggcguggugcaagacgguucaacuacucacagaaaugaaccucagcaaugggugcuuccagacuacucagguagagauucacauaauguccauuuggcuccugcuguagccccaacuuucccaggugagcaguuguuguucuucaggucaucuaugccuggguguaguggauacccuaauauggacuuggauugccuuuugccucaagaaugggugcaacacuucuaccaagagucagcaccugcucagagugacguggcucuuuugagauuuguuaacccagauacagguagagucuuguucgagugcaaacuucauaagucagguuauguuacuguggcucacacuggccaacaugaucuugucauuccaccuaauggcuauaguagauuugauucauggguuaaccaauuuuacacucuugcaccaaugggcaauggugcagggaggagaagauaa

SEQ ID NO: 8130 - RNA, 1617 nt, Artificial Sequence
  VP1__Norovirus_and/or_Norovirus-like__KC517377
augaagauggcgucgagugacgccaacccaucugauggguccgcagccaaccucgucccagaggucaacaaugagguuauggcucuggagcccguuguuggugccgccauugcggcaccuguagcgggccaacaaaacguaauugaccccuggauuagaaauaauuuuguacaagccccugguggagaguuuacaguauccccuaggaacgcuccaggugaaauacuauggagcgcgcccuugggcccugaucuaaaucccuaccuaucccauuuggccagaauguauaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaucauuacaaucaaucaaaugaccccaccauuaaguugauagcaauguuguaugcaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacggcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccggccccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaacgaaccccaacagugggugcucccaagcuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccaaacacagguaggguuuuguuugaguguaagcuucauaaaucaggcuauguuacaguggcucacacuggccaacaugauuugguuaucccccccaaugauuauuuuagguuugauuccugggucaaccaguuuuacacgcuugcccccaugggaaauggaacggggcguagacguuaa

SEQ ID NO: 8131 - RNA, 1617 nt, Artificial Sequence
  VP1__Norovirus_and/or_Norovirus-like__KC517368
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuugcacaagccccugguggagaguucacaguguccccuagaaacgcuccaggugaaauacuauggagcgcgcccuuaggcccugaucugaaccccuaccuaucucauuuggccagaauguauaaugguuaugcaggugguuuugaagugcaggugauucucgcggagaacgcguucaccgccggaaaaauuauauuugcagcagucccaccaaauuuuccaacugaaggcuugagucccagucgggucaccauguucccccauauaauaguggauguuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguccucacgaggccauccccugauuuugauuucauauuuuuggugccaccuacaguugagucaagaacuaagccauuuacugucccaauccuaacuguugaagaaacgaccaauucaagguucccaauuccuuuggagaaguuguucacgggucccagcagugccuuuguuguucaaccacaaaauggcagaugcacaacugauggcgugcucuuaggcaccacccagcugucuccugucaacaucugcaccuucagaggggaugucacccacauugcagguucucguaauuacacaaugaacuuggcuucucuaaauuggaacaacuaugucccaacagaagaaauuccagccccucuaggaacuccagauuucgugggaaagguccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccgaaaugaaccccaacaaugggugcucccaaguuauucagguagaaaugucccuaauguacaccuagccccugcuguagcccccacuuuuccgggugaacaacuccucuucuuuagguccacuaugcccggaugcagcggguaucccaacauggacuuggacugccugcuaccccaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcaugauuuggucaucccccccaaugguuauuuuagguucgauuccuggguuaaccaauucuacacgcuugcccccaugggaaacggaacggggcguagacguuaa

SEQ ID NO: 8132 - RNA, 1617 nt, Artificial Sequence
  VP1__Norovirus_and/or_Norovirus-like__AB541310
augaagaugaggucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaacaauuucguacaagccccugguggagaguucacaguauccccuagaaacgcuccaggugaaauacuguggagcgcgcccuuagguccugauuugaaucccuaccuuucccauuuggccagaauguacaaugguuaugcaggugguuuugaagugcaggugauccucgcggggaacgcguucaccgccggaaagaucauauuugcagcagucccaccaaauuucccaacugaaggcuugagccccagccaggucacuauguucccccacauaauaguagauguuaggcaauuggaaccuguguugaucccccuacccgauguuaggaauaauuucuaucacuacaaccaaucaaaugaccccaccaucaaauugauagcaauguuguauacaccacuuagggccaauaaugcuggggacgaugucuucacagguucuugucggguucucacgagaccaucccccgauuuugauuucauauuuuuaguaccacccacaguugagucaagaacuaaaccauucucugucucauuuuuuacuggugaggagaugaccaauucaagauuccccauuccuuuggaaaagcuguucacgggucccagcagugccuuuguuguucaaccacaaaacggcaggugcacgacugauggcgugcuccuagguaccacccaacugucuccugucaacaucugcaccuucagaggggaugucacccauauuacagguagucguaacuacacaaugaauuuggcuacucaaaauuggaacaguuaugacccaacagaagaaaucccagccccucuaggaacuccagauuucguggggaagauucaaggugugcucacccaaaccacaagggcagauggcucgacccgcggccacaaagcuacaguguacacugggagcgccgauuuugcuccaaaacuggguagaguucaauuugccacugacacagacaaugauuuugaugcuaaccaaaacacaaaguucaccccagucggugucauccaggauggugauacugcccaccgaaaugaaccccaacaaugggugcucccaaguuacucaggcagaaauagucacaaugugcaccuggcccccgcuguagcccccacuuuuccgggugagcaacuucucuucuucagauccacuaugcccggaugcagcggguaccccaacauggauuuggacugucugcucccccaggaaugggugcaguauuucuaucaagaggcagccccagcacaaucugauguggcucugcuaagauuugugaauccagacacagguaggguuuuguuugaguguaagcuucauaaaucaggcuauguuacaguggcucacaccggccaacaugauuugguuauuccccccaaugguuauuuuagauuugauuccugggucaaccaguucuacacacuugcccccaugggaaauggaacggggcguagacguuaa

SEQ ID NO: 8133 - RNA, 1617 nt, Artificial Sequence
  VP1__Norovirus_and/or_Norovirus-like__EF535854
augaagauggcgacgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuaggaauaauuuuguacaagccccugguggagaguucacaguauccccuagaaacgcuccaggugaaauacuauggagcgcgcccuuaggcccugaucugaauccauaccuuucucaccuggccagaauguacaaugguuaugcaggugguuuugaaguggagguaauccucgcggggaacgcguucaccgccgggaagaucauauuugcagcagucccaccaaauuucccaacugaaggcuugagccccagccaggucacuauguucccccacauaauaguagauguuaggcaauuggaaccuguguugauccccuuaccugauguuaggaauaauuucuaccauuacaaucaaucaaaugacuccaccauuaaauugauagcaaugcuguacacaccacuuagggcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugcccuuguuguccaaccacaaaauggcaggugcacgacugauggcgugcucuuaggcacuacccaacugucccccgucaacaucugcaccuucagaggcgaugucacccauauuucagguacucgcaccuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggaguguugacuuuacuccaaagcugggcagcguucaguucgccacugauacagacaaugauuuugaaacuggccaaaacacaagguucaccccagucggugucauccaggaugguaguagugcccacagaaaugaaccccaacaauggguacucccagauuacucagguagaacuguucauaauguacaccuagccccugccguagcccccacuuuuccgggugagcaacuuccuuucuucagaucuacuaugcccggaugcaguggguaucccaauauggauuuggauugucuacucccccaggaaugggugcagcacuucuaccaagaggcagccccaucacaaucugauguggcuuuguugagauuugugaauccagacacagguaggguucuguuugagugcaagcuucauaaagcaggcuaugucacaguggcucacacuggccagcaugauuugguuaucccccccaauggcuacuuuagauuugauuccugggucaaccaguccuacacacuugcccccaugggaaauggagcggggcguagacguuaa

SEQ ID NO: 8134 - RNA, 1617 nt, Artificial Sequence
  VP1__Norovirus_and/or_Norovirus-like__KX514368
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuggguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucacuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccugggaacucuaaaauuuacacaaugaauuuggccucuccaaauuggaacaauuaugacccaacagaagagaucccagccccucugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacugacacaacugaugaucuugaugcucaccaaaacacaaaauucaccccagucggugucguccaggguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccucccaauggcuacuuuagguuugauuccuggguuaaucaauucuacacacuugcccccaugggaaauggaacggggcguaagcguuaa

SEQ ID NO: 8135 - RNA, 1617 nt, Artificial Sequence
  VP1__Norovirus_and/or_Norovirus-like__KX514351
augaagauggcgucgaaugacgccaacccaucugauggguccacagccaaccucgucccagaggucaacaaugagguuauggcuuuggagcccguugucggugccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccuggucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugaaucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacaguuucuugucgaguccucacgaggccauccccugauuuugauuuuauauuccugguaccacccacaguugagucaagaucuaagcccuuuucugucccagucuuaacuguucaagaaaugaccaauucaagauuccccgcuacuuuggauaaguuguucacaggccccagcaguaaucuuguuguccaaccacagaauggcaggugcaugauugauggugugcucuuaggcaccacccaacuguccccugucaacauuugcaccuucagaggggaugucacccaccuuagggacucuacaauuuacacaaugaauuuggccucuccaaauuggaacaauuaugacccaacagaagagauuccagccccucugggaacuccagauuuugugggaaaaauccaaggugugcucacucaaacuacaaagggagaagguucgacccggggccauagagccacaguuuacguugggagugccaacuauacuccaaagcuggguaaaguucaauuugagacuaacacaacuaaugaucuuuaugcucaccaaaacacaaaauucaccccagucggugucguccaggguggugaauccgcccaccgaagugaaccccaacaaugggugcucccagguuuuucagguagagacacccccaauguacaucuagccccugcuguagcccccacuuucccaggugaacaacuucuuuucuucagauccacuauacccgggugcggcgggcaccccaacauggauuuggacugccuacucccccaggagugggugcagcacuucuaccaagaggcagcuccagcacaaucugauguggcucuguugagauuugugaauccagacacgaguaggguccuguuugagugcaaacuucauaaaucagguuaugucacaguggcccacaccggucaacaugauuugguaaucccccccaauggcuauuuuagauuugauuccuggguuaaucaauucuacacacuugcccccaugggaaauggaacggggcguaagcguuaa

SEQ ID NO: 8136 - RNA, 1617 nt, Artificial Sequence
  VP1__Norovirus_and/or_Norovirus-like__KC517372
augaagauggcgucgaaugacgccaacccaucugauggguccgcagucaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauucucgcggggaacgcguucaccgccggaaaaauuauauuugcagcagucccaccaaauuuuccaacugaaggcuugagucccagucaagucaccauguucccccauauaauaguggaugcuaggcaauuggaaccuguguugauccccuuaccugauguuaggaauaauuucuaccacuauaaucagucaaaugauucuaccauuaaauugauagcaaugcuguauacaccacuuagggcuaauaaugcuggggaagaugucuucacagucucuugucgaguucucacgaggccauccccugauuuugauuucauauuuuuggugccaccuacaguugagucaagaacuaagccauuuacugucccaauccuaacuguugaagaaaugaccaacucaagguuccccauuccuuuggagaaguuguucacgggucccagcagugccuuuguuguucaaccacaaaauggcagaugcacaacugauggcgugcucuuaggcaccacccagcugucuccuguuaacaucugcaccuucagaggggaugucgcccacauugcagguucucguaauuacacaaugaauuuggcuucucuaaauuggaacaacuaugacccaacagaagaaauuccagccccucuaggaacuccagauuucgugggaaagauccaagguaugcucacucaaaccacaaagggagauggcucgacccguggccauaaagcuacaguuuacacugggagugcccccuucacuccaaagcugggcaguguccaauucgaaacugacacagaaaaugauuuugaaacccaccaaaacacaaaauucaccccagucggugucauccaggaugguggcaccacccaccgaaaugaaccucaacaaugggugcucccaaguuauucagguagaaaugucccuaauguacaccuagccccugcuguagcccccacuuuuccgggugaacaacuccuucucuuuagguccacuaugcccggaugcagcggguaucccaacauggacuuggacugccugcuaccucaggagugggugcagcacuucuaccaagaggcagcuccagcacaaucugauguggcucuauugagauuugugaauccagacacggguaggguccuguuugagugcaaacuucauaaaucaggcuaugucacaguggcccacaccggccagcaugauuuggucaucccccccagugguuauuuuagguuugauuccuggguuaaccaauucuacacgcuugcccccaugggaaacggaacggggcguagacguuaa

SEQ ID NO: 8137 - RNA, 1617 nt, Artificial Sequence
  VP1__Norovirus_and/or_Norovirus-like__JN400613
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguggauguuaggcaauuggaaccuguguugauccccuuaccugauguuaggaauaacuucuaucacuauaaucagucaaaugauucuaccauuaaauugauagcaaugcuguauacaccacuuagggcuaauaaugcuggggaagaugucuucacagucucuugucgaguccucacgaggccuuccccugauuuugauuuuauauuuuuggugccaccuacaguugagucaagaacuaaaccauuuacugucccaaucuuaacuguugaagaaaugaccaauucaagauucccuauuccuuuggaaaaauuguucaggggucgcagcagugcucuuguuguucauccacaaaauggcagaugcacgacugauggcgugcucuuaggcaccacccaacugucuccugucaacaucugcaccuucagaggggaugucacccacauugcagguucucauaauuacacaaugaauuuggcuucucuaaauuggaacaauuaugacccaacagaagaaauuccagccccucuaggaacuccagauuucgugggaaagauccaaggugugcucacucaaaccacaaagggagaugguucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaacgagccccaacaaugggugcucccaaguuauucagguggaaauguccauaauguacaccuagccccugcuguagcccccacuuuuccgggugaacaacuucuuuucuucagguccacuaugcccggaugcagcggguaccccaacauggauuuggauugccuacucccccaggagugggugcagcacuucuaccaagaggcagcuccagcacaaucugauguggcucuauugagauuugugaauccagacacggguaggguccuguuugaguacaaacuucauaaaucagacuaugucacaguggcucacaccggucagcaugauuuggucaucccccccaaugguuauuuuagguuugauucauggguuaaucaauucuacacacuugccgccaugggaaauggaacggggcguagacguuaa

SEQ ID NO: 8138 - RNA, 1617 nt, Artificial Sequence
  VP1__Norovirus_and/or_Norovirus-like__KX514291
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuuacgggaaagauccaagguaugcucacucaaaccacaaagggagaagguucgacccggggccauagagcuacaguuuauguugggagugcuaacuaugcuccaaagcuagguagaguucaauuugaaacugacacaacuaaugaucuugaugcucaccaaaacacaaaauucaccccagucggugucauccaggguggugaaucugcccaccgaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8139 - RNA, 1617 nt, Artificial Sequence
  VP1__Norovirus_and/or_Norovirus-like__KX514219
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggugugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugccaacuaugcuccaaagcuagguagaguucaauuugaaacugacacaacuaaugaucuugaugcucaccaaaacacaaaauucaccccagucggugucguccaggguggugaauccccccaacgaagugaaccccaacaaugggugcucccaaguuauucagguagagauaccccuaauguacaucuagccccugcuguagcccccacuuucccgggugaacaacuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggccaauaugauuugguccuccccucuaaugguuauuuuagguuugauuccugggucaaucaauucuacacacuugcccccaugggaaauggaacggggcguaggcguuaa

SEQ ID NO: 8140 - RNA, 1617 nt, Artificial Sequence
  VP1__Norovirus_and/or_Norovirus-like__AB933668
augaagauggcgucgaaugacgccaacccaucugauggguccgcagccaaccucgucccagaggucaacaaugagguuauggcuuuggagcccguuguuggugccgccauugcggcgccuguagcgggccaacaaaauguaauugaccccuggauuagaaauaauuuuguacaagccccugguggagaguuuacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgucgugaaaacuacuuugucagcagucccaccaaauuucccaacugaaggcuugagucccagccaggucacuauguucccccacauaauaguggauguuaggcaauuggaaccuguguugaucccccuaccugauguuaggaauaacuucuaucacuauaaucagucaaaugauucuaccauuaaauugauagcaaugcuguauacaccacuuagggcuaauaaugcuggggaggaugucuuuacagucucuugucgaguucucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaauuguucacgggucccagcagugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggccucucuaaauuggaacaauuaugacccaacagaagaaauuccagccccucuaggaacuccagauuuugugggaaagauccaaggugugcucacucaaaccacaaagggagauggcucgacccguggccauaaagcuacaguuuacacugggagugcccccuuuacuccaaagcugggcaguguccaauucaguacugauacagagaaugauuuugaaacucaccaaaacacaaaguucaccccggucggugucauccaggaugguggcaccacccaucgaaaugaaccccaacaaugggugcucccaaguuauucagguagaaaugucccuaauguacaccuagccccugcuguagcccccacuuuuccgggugaacaacuucuuuucuuuagguccacuaugcccggaugcagcggguaucccaacauggauuuggacugccuacucccccaggagugggugcagcacuucuaccaagaagcagcuccggcacaaucugauguggcucuauugagauuugugaauccagacacggguaggguccuguuugagugcaaacuucauaaaucaggcuaugucacaguggcucacaccggccagcaugauuuggucaucccccccaaugguuauuuuagguuugauuccuggguuaaucaauuuuacacacuugcccccaugggaaauggaacggggcguagacguuaa

SEQ ID NO: 8141 - RNA, 1617 nt, Artificial Sequence
  VP1__Norovirus_and/or_Norovirus-like__KJ678149
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaauauccccuagaaacgcuccaggugaaauacuauggagcgcgcccuugggcccugaucuaaaucccuaccuaucccauuuggccagaauguacaaugguuaugcaggugguuuugaagugcagguaauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugacuccaccauuaaguugauagcaauguuguauacaccacuuagggcuaauaaugcuggggaugaugucuucacaguuucuugccgaguucucacgagaccaucccccgauuuugaucucauauuucuagugccacccacaguugagucaagaacuaaaccauucucugucccaguuuuaacuguugaggagaugaccaauucaagauuccccacuccuuuggaaaaguuguucacgggucccagcagugccuuuguuguucaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuucguggggaagauucaaggcgugcucacccaaaccacaaggacagauggcucaacacgcggccacaaagccacaguguacacugggagcgccgacuuugcuccaaaacugggcagaguucaauuugaaacugacacagaccaugauuuugaaacuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccauacccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 8142 - RNA, 1617 nt, Artificial Sequence
  VP1__Norovirus_and/or_Norovirus-like__KP244318
augaagauggcgucgagugacgccaacccaucugauggguccacagccaaccucgucccagaggucaacaaugagguuauggcuuuggagcccgugguuggugccgccauugcggcaccuguagcgggccaacaaaauguaauugaccccuggauuagaaacaauuuuguacaagccccugguggagaguuuacaguauccccuagaaacgcuccaggugaaauauuauggagcgcgcccuuaggcccugaccugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguuuccccauauaauaguagauguuaggcaauuggaaccuguauugauccccuuacccgauguuaggaauaauuucuaucauuauaaucaaucaaaugaccccaccaucaaauugauagcaauguuguacacaccacuuagggcuaauaaugcuggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaauggcaggugcacgacugauggcgugcuccuagguacuacccaauuguccccugucaacauccgcaccuucagaggggaugucacccauauuccaggcagucguaacuacacaaugaauucggccucccaaaauuggaacaguuacgauccaacagaagaaaucccagccccucuaggaacuccagauuucguggggaagauucaaggugugcucacccaaaccacaagggcaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggauggcagcaccaccccccgaaaugaaccccaacaaugggugcucccaaguuacucaggcagaaacauucauaaugugcaccuggcccccgcuguagcccccacuuucccgggcgaacagcuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugccccuaugggaaaugggacggggcguagacguuaa

SEQ ID NO: 8143 - RNA, 1617 nt, Artificial Sequence
  VP1__Norovirus_and/or_Norovirus-like__KX514362
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguacacaccacuuagggccaauaaugcuggggaugaugucuucacagucuccugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccugggggcucuaaaauuuacacaaugaauuuggccucuccaaauuggaacaauuaugacccaacagaagagauuccagccccucugggaacuccagauuuuguaggaaagauccaagguaugcucacucaaaccacaaagggagaagguucgacccggggccauagagcuacaguuuauguugggagugccaacuaugcuccaaagcuagguagaguucaauuugaaacugacacaacugaugaucuugaugcucaccaaaacacaaaauucaccccagucggugucguccaggguggugaaucccccaaaggaagugaaccccaacaaugggugcucccaaguuauucagguagagauacccccaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucauccccccuaauggcuacuuuagguuugauuccuggguuaaucaauucuacacacuugcccccaugggaaauggaacggggcguaagcguuaa

SEQ ID NO: 8144 - RNA, 1617 nt, Artificial Sequence
  VP1__Norovirus_and/or_Norovirus-like__KX514329
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguuuccccauauaauaguagauguuaggcaauuagaaccuguguugauccccuuaccugauguuaggaauaacuucuaucauuauaaucagucaaaugauucuaccauuaaauugauagcaaugcuguacacaccacuuagggccaauaaugcuggggaugaugucuucacagucuccugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacucugggaacucuaaaauuuacacaaugaauuuggccucuccaaauuggaacaauuaugacccaacagaagagauuccagccccucugggaacuccagauuuuguaggaaagauccaagguaugcucacucaaaccacaaagggagaagguucgacccggggccauagagcuacaguuuauguugggagugccaacuaugcuccaaagcuagguagaguucaauuugaaacugacacaacugaugaucuugaugcucaccaaaacacaaaauucaccccagucggugucguccaggguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccucccaauggcuacuuuagguuugauuccuggguuaaucaauucuacacacuugcccccaugggaaauggaacggggcguaagcguuaa

SEQ ID NO: 8145 - RNA, 1617 nt, Artificial Sequence
  VP1__Norovirus_and/or_Norovirus-like__KJ678152
augaagauggcgucgagugacgccaacccuugugauggguccgcagccaaccucgucccagaggucaacaaugagguuauggcucuggagcccguuguuggugccgccauugcggcaccuguaggcggccaacaaaauguaauugaccccuggauuagaaauaauuuuguacaagccccugguggagaguuuacaguauccccuagaaacgcuccaggugaaauacuauggagcgcgcccuugggcccugauuuaaaucccuaccuaucccauuuggccagaauguacaaugguuaugcaggugguuuugaagugcaggugauucucgcggggaacgcguucaccgccggaaaggucauauuugcagcagucccaccaaauuuuccaacugaaggcuugagccccagccaggucacuauguucccccauauaguaguagauguuaggcaacuagaaccuguguugauucccuuacccgauguuaggaauaauuucuaccauuacaaucaaucaaaugacuccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccacuccuuuggaaaaguuguucacgggucccagcagugccuuuguuguucaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuucguggggaagauucaaggcgugcucacccaaaccacaaggacagauggcucaacacgcggccacaaagccacaguguacauugggagcgccgacuuugcuccaaaacugggcagaguucaauuugaaacugacacagaccaugauuuugaaacuaaccaaaacacaaaauucaccccaguuggugucauccaagaugguagcaccacccaccgaaaugaaccccaacagugggugcucccaaguuacucaggcagaaauacuccuaaugugcaucuggcccccgcuguagcccccacuuuuccgggugagcaacuucucuucuucagauccaccuugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 8146 - RNA, 1617 nt, Artificial Sequence
  VP1__Norovirus_and/or_Norovirus-like__KX514352
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugccaacuaugcuccaaagcuagguagaguucaauuugaaacugacacaacuaaugaucuuuaugcucaccaaaacacaaaauucaccccagucggugucguccaggguggugaauccgcccaccgaagugaaccccaacaaugggugcucccagguuauucagguagagacacccccaauguacaucuagccccugcuguagcccccacuuucccaggugaacaacuucuuuucuucagauccacuauacccgggugcggcgggcaccccaacauggauuuggacugccuacucccccaggagugggugcagcacuucuaccaagaggcagcuccagcacaaucugauguggcucuguugagauuugugaauccagacacgaguaggguccuguuugagugcaaacuucauaaaucagguuaugucacaguggcucacaccggucaacaugauuugguaaucccccccaauggcuauuuuagauuugauuccuggguuaaucaauucuacacacuugcccccaugggaaauggaacggggcguaagcguuaa

SEQ ID NO: 8147 - RNA, 1617 nt, Artificial Sequence
  VP1__Norovirus_and/or_Norovirus-like__KX514339
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguacacaccacuuagggccaauaaugcuggggaugaugucuucacagucuccugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccaaucugggaacacuaaaauuuacacaaugaauuuggccucuccaaauuggaacaauuaugacccaacagaagagaucccagccccucugggaacuccagauuuuguaggaaagauccaagguaugcucacucaaaccacaaagggagaagguucgacccggggccauagagcuacaguauauguugggagugccaacuaugcuccaaagcuagguagaguucaauuugaaacugacacaacugaugaucuugaugcucaccaaaacacaaaauucaccccagucggugucguccaggguggugaaucccccaaaggaagugaaccccaacaaugggugcucccaaguuauucagguagagauacccccaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucauccccccuaauggcuacuuuagguuugauuccuggguuaaucaauucuacacacuugcccccaugggaaauggaacggggcguaggcguuaa

SEQ ID NO: 8148 - RNA, 1617 nt, Artificial Sequence
  VP1__Norovirus_and/or_Norovirus-like__KR904238
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguguccccuagaaacgcuccaggugaaauacuauggagcgcgcccuuaggcccugaucuaaaucccuaccuaucccauuuggccagaauguauaaugguuaugcaggugguuuugaagugcagguaauucucgcggggaacgcguucaccgccgggaagaucauauuugcagcagucccaccaaauuuuccaacugaaggcuuaagccccagccaggucacuauguucccccauauaauaguagauguuagacagcuagaaccugugcugauuccccuacccgaugucaggaauaauuucuaucauuacaaucaaucaaaugauuccacuauuaaguugauagcaauguuguauacaccacuuagggcuaauaaugcuggggacgaugucuucacagucucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacaacugauggcgugcuccuaggcaccacccaacugucuccugucaacaucugcaccuucagaggggaugucacccacaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagaugguucaacacgcggccacaaagcuacaguguacacugggagugccgacuuugcuccaaaacuggguagaguucaauuugaaacugacacagaccaugauuuugaagcuaaccaaaacacaaaguucaccccagucggugucauccaagaugguagcaccacccaccggaaugaaccccaacagugggugcucccaaguuacucaggcagaaauacucauaaugugcaucuggcccccgcuguagcccccacuuuuccgggugagcaacuucccuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugaguguaagcuucacaaaucaggcuauguuacaguggcucacacuggccaacaugauuugguuaucccccccuaugguuacuucagguuugauuccugggucaaccaguucuacacgcuugcccccaugggaaauggaacggggcguaggcgauaa

SEQ ID NO: 8149 - RNA, 1617 nt, Artificial Sequence
  VP1__Norovirus_and/or_Norovirus-like__KJ710245
augaagauggcgucgagugacgccaacccaucugauggguccacagccaaccucgucccagaggucaacgaugagguuauggcuuuggagcccguuguuggugccgcccuugcggcaccuguagcgggccaacaaaauguaauugaccccuggauuagaaacaauuuuguacaagccccugguggagaguucacaguauccccuagaaacgcuccaggugaaauacuauggagcgcgcccuuaggccccgauuugaaucccuaccuuucucauuuggccagaauguacaaugguuaugcaggugguuuugaagugcaggugauccucgcggggaaugcguucaccgccggaaaggucauauuugcagcagucccaccaaauuucccaacugaaggcuugagccccagccaggucacuauguucccccacauaauaguagauguuaggcaauuggaaccuguguugauccccuuacccgaugcuaggaauaauuucuaccacuacaaucaaucaaaugaauccaccaucaaauugauagcaauguuguauacaccacuuagggcuaacaaugcuggggacgaugucuucacagucucuugucgaguccucacgagaccaucccucgauuuugauuucauauuuuuagugccacccacaguugagucaagaacuaaaccauucucugucccaauuuuaacuguugaggaaaugaccaauucaagauuccccauuccuuuggaaagauuguucacgggucccagcagugccuuugccguucaaccacaaaacggcaggugcacgacugauggcgugcuccuagguacuacucaacugucuccugucaacaucugcaccuucagaggagaugucacccacaccacagguagucacaacuacacaaugaauuuggcuucccaaaaucggagcaauuaugacccaacagaagaaaucccagccccucuaggaacuccagacuucguggggaagauucaaggugcgcucacccaaaccacaagggcagauggcucgacccgcggccacaaagcuacaguguacacugggagcgccgacuuuacuccaaaacuggguagaguucaauuugccacugauacagaccaugauuuugauacuaaccaaaacacaaaguucaccccagucggugucauccaggaugguucuacuacccaccggaaugaaccccaacaaugggugcucccaaguuacucaggcagaaauacucauaaugugcaccuggcccccgcuguggcccccacuuuuccgggugaacagcuucucuucuuuagguccacuaugcccggauguaguggguaccccaacauggauuuggacugccugcucccccaagaauggguggcgcacuucuaccaagaggcagcccccgcacaaucugauguggcucugcuaagauuugugaauccagauacaggcaggguuuuguuugaguguaagcuucauaaaucaggcuauguuacaguggcucacacuggccaacaugauuugguuaucccccccaaugguuacuuuagauuugauuccugggucaaccaguucuacacacuugcccccaugggaaauggaacggggcguagacguuaa

SEQ ID NO: 8150 - RNA, 1617 nt, Artificial Sequence
  VP1__Norovirus_and/or_Norovirus-like__KX514298
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacgguuucuugccgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugccaacuaugcuccaaagcuagguagaguucaauuugaaacugacacaacuaaugaucuugaugcucaccaaaacacaaaauucaccccagucggugucauccaggguggugaauccgcccaccgaagugaaccccaacaaugggugcucccaaguuauucagguagagauaucccuaaugugcaucuagccccugcuguagcccccacuuucccgggugaacaacuucucuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8151 - RNA, 1617 nt, Artificial Sequence
  VP1__Norovirus_and/or_Norovirus-like__KX514269
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuuacgggaaagauccaagguaugcucacucaaaccacaaagggagaagguucgacccggggccauagagcuacaguuuauguugggagugcuaacuaugcuccaaagcuagguagaguucaauuugaaacugacacaacuaaugaucuugaugcucaccaaaacacaaaauuuaccccagucggugucguccagaguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8152 - RNA, 1617 nt, Artificial Sequence
  VP1__Norovirus_and/or_Norovirus-like__KX514179
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugacuaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucucaaauuuacacaaugaauuuggccucuccaaauuggaacaauuaugacccaacagaagagaucccagccccucugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacugacacaacuaaugaucuugaugcucaccaaaacacaaaauucaccccagucggugucguccaggguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccucccaauggcuacuuuagguuugauuccuggguuaaucaauucuacacacuugcccccaugggaaauggaacggggcguaagcguuaa

SEQ ID NO: 8153 - RNA, 1617 nt, Artificial Sequence
  VP1__Norovirus_and/or_Norovirus-like__KX514289
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguggauguuaggcaauuagaaccuguguugauccccuuaccugauguuaggaauaacuucuaucauuauaaucagucaaaugauucuaccauuaaauugauagcaaugcuguacacaccacuuagggccaauaaugcuggggaugaugucuucacagucuccugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaggguucgacccggggccauagagcuacaguuuauguugggagugcuaacuaugcuccaaagcuagguagaguucaauuugaaacugacacaacuaaugaucuugaugcucaccaaaacacaaaauucaccccagucggugucguccagaguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8154 - RNA, 1617 nt, Artificial Sequence
  VP1__Norovirus_and/or_Norovirus-like__KX514288
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacugacacaacuaaugaucuugaugcucaccaaaacacaaaauucaccccagucggugucguccagaguggugaaucccccaaaggaagugaaccccaacaaugggugcucccaaguuauucagguagagauaccccuaauguacaucuagccccugcuguagcccccacuuucccgggugaacaacuucuuuucuucagguccacuauacccggaugcggcgggcaucccaacauggauuuggauugccuacucccccaggagugggugcaacacuucuaccaagaggcagcuccagcacaaucugauguggcucuauugagauuugugaauccagacacaaguaggguucuguuugagugcaaacuucauaaaucagguuaugucacaguggcucacaccggucaacaugauuugguuauccccccaaauggcuacuuuagauuugauuccugggucaaucaauucuacacacuugcccccaugggaaauggaacggggcguaagcguuaa

SEQ ID NO: 8155 - RNA, 1617 nt, Artificial Sequence
  VP1__Norovirus_and/or_Norovirus-like__KX514268
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaaucauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaugguaugcucacucaaaccacaaagggagaagguucgacccggggccauagagcuacaguuuauguugggagugcuaacuaugcuccaaagcuagguagaguucaauuugaaacugacacaacuaaugaucuugaugcucaccaaaacacaaaauucaccccagucggugucguccaggguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8156 - RNA, 1617 nt, Artificial Sequence
  VP1__Norovirus_and/or_Norovirus-like__JX459653
augaagauggcgucgagugaccccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaaguacagguaauccucgcggggaacgcguucaccgccgggaaaaucauauuugcagcagucccaccaaauuuuccaacugaagguuugagccccagccaggucacuauguucccccacauaauaguagauguuaggcaauuggaaccuguguugauccccuuacccgauguuaggaauaauuucuaccauuauaaucaaucaaacgacuccaagcucaaauugagaccgauguuguacacaccacuuagggcuaauaaugccggggacgaugucuucacaguuucuugucggguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguaccacucaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaagcuggguagaguucaauuugccacugacacagacaaugauuuugaaacuaaccaaaacacaaaauucaccccagucggcguuauccaggaugguaguaccaccccccgaaaugaaccccaacaaugggugcucccaaguuacucaggcagaaacauucacaaugugcaccuggcccccgcuguagcccccacuuucccgggcgagcagcuccucuucuucagaucuacuaugcccggaugcagcggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 8157 - RNA, 1617 nt, Artificial Sequence
  VP1__Norovirus_and/or_Norovirus-like__KX514359
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagucaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugccaacuaugcuccaaagcuagguagaguucaauuugaaacugacacaacuaaugaucuugaugcucaccaaaacacaaaauucaccccagucggugucguccaggguggugaauccccccaacgaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8158 - RNA, 1617 nt, Artificial Sequence
  VP1__Norovirus_and/or_Norovirus-like__KX514296
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcaggugguuuugaagugcaggugauccucgcggggaaugcguuuaccgcgggaaagauuauauuugcagcaguuccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacuggcacaacuaaugaucuugaugcucaccaaaacacaaaauucaccccagucggugucguccaggguggugaauccccccaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8159 - RNA, 1617 nt, Artificial Sequence
  VP1__Norovirus_and/or_Norovirus-like__KX514284
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguuaauccccuuaccugauguuaggaauaacuucuaucauuauaaucagucaaaugauucuaccauuaaauugauagcaaugcuguacacaccacuuagggccaauaaugcuggggaugaugucuucacagucuccugucgaguccucacgaggccauccccugauuuugauuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugccaacuaugcuccaaagcuagguagaguucaauuugaaacugacacaacuaaugaucuugaugcucaccaaaacacaaaauucaccccagucggugucguccaggguggugaauccccccaacgaagugaaccccaacaaugggugcucccaaguuauucagguagagauaccccuaauguacaucuagccccugcuguagcccccacuuucccgggugaacaacuucuuuucuucagguccacuauacccggaugcggcgggcaucccaacauggauuuggauugccuacucccccaggagugggugcaacacuucuaccaagaggcagcuccagcacaaucugauguggcucuauugagauuugugaauccagacacaaguaggguucuguuugagugcaaacuucauaaaucagguuaugucacaguggcucacaccggucaacaugauuugguuaucccccccaauggcuacuuuagauuugauuccugggucaaucaauucuacacacuugcccccaugggaaauggaacggggcguaagcguuaa

SEQ ID NO: 8160 - RNA, 1617 nt, Artificial Sequence
  VP1__Norovirus_and/or_Norovirus-like__KX514245
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacagucuauguugggagugccaacuaugcuccaaagcuagguagaguucaauuugaaacugacacaacuaaugaucuugaugcucaccaaaacacaaaauucaccccagucggugucguccaggguggugaauccccccaacgaagugaaccccaacaaugggugcucccaaguuauucagguagagauaccccuaauguacaucuagccccugcuguagcccccacuuucccgggugaacaacuucuuuucuucagauccacuauacccggguguggcgggcaucccaacaugaauuuggauugccuacucccccaggagugggugcagcacuucuaucaagaggcagcuccagcacaaucugauguggcucuauugagauuugugaauccggacacgaguaggguccuguuugagugcaaacuucauaaaucagguuaugucacagugacucacaccggucaacaugauuuggucaucccccccaauggcuacuuuagguuugauuccuggguuaaucaauucuacacacuugcccccaugggaaauggaacggggcguaagcguuaa

SEQ ID NO: 8161 - RNA, 1617 nt, Artificial Sequence
  VP1__Norovirus_and/or_Norovirus-like__KX514327
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuagaaccuguguugauccccuuaccugauguuaggaauaacuucuaucacuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacucugggaacucuaaaauuuacacaaugaauuuggccucuccaaauuggaacaauuaugacccaacagaagagaucccagccccucugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacugacacaacugaugaucuugaugcucaccaaaacacaaaauucaccccagucggugucguccaggguggugaaucccccaaaggaagugaaccccaacaaugggugcucccaaguuauucagguagagauacccccaauguacaucuagccccugcuguagcccccacuuucccgggugaacaacuucucuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucauccccccuaauggcuacuuuagguuugauuccuggguuaaucaauucuacacacuugcccccaugggaaauggaacggggcguaagcguuaa

SEQ ID NO: 8162 - RNA, 1617 nt, Artificial Sequence
  VP1__Norovirus_and/or_Norovirus-like__KX514301
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagucaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucuggggacuccagauuuugugggaaagauccaagguaugcucacucaaacuacaaagggagaagguucgacccggggccauagagcuacaguuuauguugggagugcuaacuaugcuccaaagcuagguagaguccaauuugaaacugacacaacuaaugaucuugaugcucaccaaaacacaaaauucaccccagucggugucguccaggguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaagcagcuccagcacaaucugauguggcucuauugagauuugugaauccagacacgaguaggguccuguuugagugcaaacuucauaaaucagguuaugucacaguggcucacaccggucaacaugauuugguuaucccccccaauggcuacuuuagguuugauuccuggguuaaucaauucuacacacuugcccccaugggaaauggaacggggcguaagcguuaa

SEQ ID NO: 8163 - RNA, 1617 nt, Artificial Sequence
  VP1__Norovirus_and/or_Norovirus-like__KX514299
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagccccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugccaacuaugcuccaaagcuagguagaguucaauuugaaacugacacaacuaaugaucuugaugcucaccaaaacacaaaauucaccccagucggugucguccaggguggugaauccccccaaggaagugaaccccaacaaugggugcucccaaguuauucagguagagauacccccaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8164 - RNA, 1617 nt, Artificial Sequence
  VP1__Norovirus_and/or_Norovirus-like__KX514277
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaacugaaucccuaccuaucucauuuggcuagaauguauaaugguuaugcagguggcuuugaagugcaagugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacugacacaacuaaugaucuugaugcucaccaaaacacaaaauucaccccagucggugucguccaggguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccucccaauggcuacuuuagguuugauuccuggguuaaucaauucuacacacuugcccccaugggaaauggaacggggcguaagcguuaa

SEQ ID NO: 8165 - RNA, 1617 nt, Artificial Sequence
  VP1__Norovirus_and/or_Norovirus-like__KX514213
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcaggugguuuugaagugcaggugauccucgcggggaaugcguuuaccgcggggaaaauuauauuugcagcagucccuccaaauuuuccaacugaaggcuugagucccagccaggucacuauguucccccauauaauaguagauguuaggcaauuagaaccuguguugauucccuuaccugauguuaggaauaauuuuuaucauuauaaucagucaaaugauucuaccauuaaauugauagcaaugcuguauacaccacuuagggccaauaaugcuggggaugaugucuucacaguuucuugucgaguccucacgaggccauccccugauuuugauuuuauauuccugguaccacccacaguugagucaagaucuaagcccuuuucugucccagucuuaacuguucaagaaaugaccaauucaagauuccccgcuacuuuggauaaauuguucacaggucccagcaguaaucuuguuguccaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugccaacuaugcuccaaagcuagguagaguucaauuugaaacugacacaacuaaugaucuugaugcucaccaaaacacaaaauucaccccagucggugucguccaggguggugaauccccccaacgaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8166 - RNA, 1617 nt, Artificial Sequence
  VP1__Norovirus_and/or_Norovirus-like__KT033903
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaguuggaaccuguguugauccccuuacccgauguuaggaauaauuucuaucauuauaaucaaucaaaugacuccaccaucaaauugauagcaauguuguacacaccacuuagggcuaauaaugccgggggcgaugucuucacaguuucuugucgaguucucacgagaccaucccccgauuuugauuuuauauuuuuggugccacccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaauugucuccugucaacaucugcaccuucagaggggaugucacccauauuccaggcagucguaacuacacaaugaauuuggccucccaaaacuggaacaguuacgauccgacagaagaaaucccagccccucuaggaacuccagauuuuguggggaaaguucaaggugugcucacccaaaccacaaggacaaauggcucgacccgcggccacaaagcuacaguguacacugggagcgccgacuuuucuccaaaacuggguaggguucaauuugccacugacacagacaaugauuuugaaacuaaccaaaacacaaaguucaccccagucggcguuauccaggaugguagcaccaccccccgaaaugaaccccaacaaugggugcucccaaguuacucaggcagaaacauucacaaugugcaccuggcccccgcuguagccccuacuuucccgggcgagcagcuccucuucuucagaucuacuaugcccggaugcagcggguaucccaacauggacuuggacugucugcucccccaggagugggugcaguacuucuaccaggaggcagccccagcacaaucugauguggcucuguuaagauuugugaauccagacacaguuaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 8167 - RNA, 1617 nt, Artificial Sequence
  VP1__Norovirus_and/or_Norovirus-like__HM625866
augaagauggcgucgagugacgccaacccaucugauggguccacagccaaccucgucccagaggucaacaaugagguuauggcuuuggagcccguaguuggugccgccagugcggcgccuguagcgggccaacaaaauguaauugaccccuggauuagaaacaauuuuguacaagccccugguggagaguuuacagaauccccuacaaacgcuccaggugaaauauuauggagcgcgcccuuaggcccugaucugaaccccuaccuuucccauuuggccagaauguacaaugguuaugcaggugguuuugaagugcagguaauccucgcggggaacgcguucaccgccgggaaaaucauauuugcagcaguuccaccaaauuucccaacugaagguuugagccccagccaggucacuauguuuccccauauaauaguagauguuaggcaauuggaaccuguguugauccccuuacccgauguuaggaauaauuucuaccauuauaaucaaucaaaugaccccaccaucaaauugauagcaauguuguacacaccacuuagggcuaauaaugcuggggaugaugucuucacaguuucuugucgaguucucacgagaccaucccccgauuuugauuucauauuuuuggugccagccacaguugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguacuacccaacuguccccugucaacaucugcaccuucagaggggaugucacccauauuccagguagucguaacuacacaaugaauuuggccucccaaaauuggaacaguuacgauccaacagaagaaaucccagccccuguaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucgguguuauccaggaugguaguaccaccccccgaaaugaaccccaacaaugggugcucccaaguuacucaggcagaaacauucauaaugugcaccuggcccccgcuguagcccccacuuucccgggcgaacaacuccucuucuucagaucuacuaugcccggaugcagcggguaccccaacauggauuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugccccuaugggaaaugggacggggcguagacguuaa

SEQ ID NO: 8168 - RNA, 1617 nt, Artificial Sequence
  VP1__Norovirus_and/or_Norovirus-like__KX514319
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauucuaccauuaaauugauagcaaugcuguacacaccacuuagggccaauaaugcuggggaugaugucuucacagucuccugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccugggggcucuaaaauuuacacaaugaauuuggccucuccaaauuggaacaauuaugacccaacagaagagauuccagccccucugggaacuccagauuuuguaggaaagauccaagguaugcucacucaaaccacaaagggagaagguucgacccggggccauagagcuacaguuuauguugggagugccaacuaugcuccaaagcuagguagaguucaauuugaaacugacacaacugaugaucuugaugcucaccaaaacacaaaauucaccccagucggugucguccaggguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacauggacuuggauugccugcucccccaggagugggugcagcacuucuaccaagaggcagcuccagcacaaucugauguggcucuauugagauuugugaauccagacacgaguaggguccuguuugagugcaaacuucauaaaucagguuaugucacaguggcucacaccggucaacaugauuuggucauccccccuaauggcuacuuuagguuugauuccuggguuaaucaauucuacacacuugcccccaugggaaauggaacggggcguaggcguuaa

SEQ ID NO: 8169 - RNA, 1617 nt, Artificial Sequence
  VP1__Norovirus_and/or_Norovirus-like__KX514311
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcagaugcaugauugauggcgugcucuuaggcaccacccaacugucuccuguuaacauuugcaccuucagaggggaugucacccacccugggggcucuaaaauuuacacaaugaauuuggccucuccaaauuggaacaauuaugacccaacagaagagauuccagccccucugggaacuccagauuuuguaggaaagauccaagguaugcucacucaaaccacaaagggagaagguucgacccggggccauagagcuacaguuuauguugggagugccaacuaugcuccaaagcuagguagaguucaauuugaaacugacacaacugaugaucuugaugcucaccaaaacacaaaauucaccccagucggugucguccaggguggugaaucccccaaaggaagugaaccccaacaaugggugcucccaaguuauucagguagagauacccccaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucauccccccuaauggcuacuuuagguuugauuccuggguuaaucaauucuacacacuugcccccaugggaaauggaacggggcguaagcguuaa

SEQ ID NO: 8170 - RNA, 1617 nt, Artificial Sequence
  VP1__Norovirus_and/or_Norovirus-like__KX514266
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguuuccccauauaauaguagauguuaggcaauuagaaccuguguugauccccuuaccugauguuaggaauaacuucuaucauuauaaucagucaaaugauucuaccauuaaauugauagcaaugcuguacacaccacuuagggccaauaaugcuggggaugaugucuucacagucuccugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuggggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacugacacaacuaaugaucuugaugcucaccaaaacacaaaauucaccccagucggugucguccaggguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8171 - RNA, 1617 nt, Artificial Sequence
  VP1__Norovirus_and/or_Norovirus-like__KX514235
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaagugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugccaacuaugcuccaaagcuagguagaguucaauuugaaacugacacaacuaaugaucuugaugcucaccaaaacacaaaauucaccccagucggugucguccaggguggugaauccccccaacgaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuugguuaucccccccaauggcuacuuuagguuugauuccuggguuaaucaauucuacacacuugcccccaugggaaauggaacggggcguaagcguuaa

SEQ ID NO: 8172 - RNA, 1617 nt, Artificial Sequence
  VP1__Norovirus_and/or_Norovirus-like__KX354115
augaagauggcgucgagugacgccaacccaucugauggguccgcagccaaccucgucccagaggccaacaaugagguuauggcuuuggagcccguugcuggugccgcccuugcggcaccuguagcgggucaacaaaauguaauugaccccuggauuagaaacaauuuuguacaagccccugguggagaguuuacaauauccccuagaaacgcuccaggugagauacuauggagcgcgcccuugggaccugaucugaaucccuaccuaucccauuuggccagaauguacaaugguuaugcaggugguuuugaagugcagguaauucucgcggggaacgcguucaccgccgggaaggucauauuugcagcagucccaccaaauuuuccaacuucaggcuugagccccagccaggucacuauguuccccaguguaguaguggauguuaggcaacuagaaccuguguugauucccuuacccgauguuaggaauaacuuuuaucauuauaaucaaucaaaugaccccaccaucacuuugauagcaauguuguacacuccacucagggcuaacaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaggcuguucacgggccccagcagugccuuuguuguucaaccacaaaacggcaggugcacgacugauggcgugcuccuaggcaccacccaacugucuccugucaacauuugcaccuucagaggagauaucauccauaucacagguagucauaacuacacaaugaauuuggcuucucaaaauuggaacaauuaugacccaacagaagaaaucccagccccccuaggaacuccagacuuuguagggaagauucaaggcgugcucacccaaaccacaaggggggauggcucaacacgcggccacaaagccacaguguacacugggagcgccgauuuuauuccaaaacuggguagaguccaauuugaaacugacacaaaccaugauuuugaagcuaaccaaaacacaaaguucaccccagucggugucauccaagaugguagcaccacccaccgaaaugaaccccaacagugggugcucccaaguuacucaggcagaaacacucauaaugugcaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaagcuucauaaaucaggcuacauuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 8173 - RNA, 1617 nt, Artificial Sequence
  VP1__Norovirus_and/or_Norovirus-like__KM272334
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuaggaacgcuccaggugaaauacuauggagcgcgcccuugggcccugaucuaaaucccuaccuaucccauuuggccagaacguacaaugguuaugcaggugguuuugaagugcagguaauucucgcggggaacgcguucaccgccgggaaggucauauuugcagcagucccaccaaauuuuccaacugaaggcuugagccccagccaggucacuauguucccccauauaguaguagaugcuaggcaacuagaaccuguguugauucccuuacccgauguuaggaauaauuucuaucauuacaaucaaucaaaugaccccaccauuaaguugauagcaauguuguauacaccacuuagggcuaauaaugcuggggaugaugucuucacaguuucuugccgaguucucacgagaccaucccccgauuuugauuucauauuucuagugccacccacaguugagucaagaacuaaaccauucucugucccaguuuuaacuguugaggagaugaccaauucaagauuccccaucccuuuggaaaaguuguucacgggucccagcagugccuuuguuguccaaccacaaaacagcaggugcacgacugauggcgugcuccuaggcaccacccaacugucuccugucaacaucugcaccuucagaggagaugucacccauaucacagguagucguaacuacacaaugaauuuggcuucucaaaauuggaacaauuaugacccaacagaagaaaucccggucccucuaggaacuccagauuuuguggggaagauucaaggcgugcucacccaaaccacaaggacagauggcucaacacgcggccacaaagcuacaguguacacugggagcgccgacuuugcuccaaaacuggguagaguucaauuugaaacugacacagaccaugauuuugaagcuaaccaaaacacaaaguucaccccaguuggugucauccaagaugguggcaccacccaccgaaacgaaccccaacagugggugcucccaagcuacucaggcagaaauacucauaaugugcaucuggcccccgcuguagcccccacuuuuccgggugagcaacuucucuucuucagauccaccaugcccggaugcagcggguaccccaacauggauuuggacugucugcucccccaggaaugggugcaguacuucuaccaaggggcagccccagcacaaucugauguggcucugcuaagauuugugaauccagacacagguaggguuuuguuugaguguaagcuucauaaaucaggcuauguuacaguggcucacacuggccaacaugauuugguuaucccccccaaugguuauuuuagguuugauuccugggucaaccaguuuuacacgcuugcccccaugggaaauggaacggggcguagacguuaa

SEQ ID NO: 8174 - RNA, 1617 nt, Artificial Sequence
  VP1__Norovirus_and/or_Norovirus-like__KX354116
augaagauggcgucgagugacgccaacccaucugauggguccgcagccaaccucgucccagaggccaacaaugagguuauggcuuuggagcccguugcuggugccgcccuugcggcaccuguagcgggucaacaaaauguaauugaccccuggauuagaaacaauuuuguacaagccccugguggagaguuuacaauauccccuagaaacgcuccaggugagauacuauggagcgcgcccuugggaccugaucugaaucccuaccuaucccauuuggccagaauguacaaugguuaugcaggugguuuugaagugcagguaauucucgcggggaacgcguucaccgccgggaaggucauauuugcagcagucccaccaaauuuuccaacugcaggcuugagccccagccaggucacuauguuccccaguguaguaguggauguuaggcaacuagaaccuguguugauucccuuacccgauguuaggaauaacuuuuaucauuauaaucaaucaaaugaccccaccaucacuuugauagcaauguuguacacuccacucagggcuaacaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaggcuguucacgggccccagcagugccuuuguuguucaaccacaaaacggcaggugcacgacugauggcgugcuccuaggcaccacccaacugucuccugucaacauuugcaccuucagaggagauaucauccauaucacagguagucauaacuacacaaugaauuuggcuucucaaaauuggaacaauuaugacccaacagaagaaaucccagccccccuaggaacuccagacuuuguagggaagauucaaggcgugcucacccaaaccacaaggggggauggcucaacacgcggccacaaagccacaguguacacugggagcgccgauuuuauuccaaaacuggguagaguccaauuugaaacugacacaaaccaugauuuugaagcuaaccaaaacacaaaguucaccccagucggugucauccaagaugguagcaccacccaccgaaaugaaccccaacagugggugcucccaaguuacucaggcagaaacacucauaaugugcaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaagcuucauaaaucaggcuacauuacaguggcucacacuggccaacaugauuugguuauuccccccaaugguuauuuuagauuugauuccugggucaaccaguucuacacgcuugcccccaugggaaauggaacggggcguagacguuaa

SEQ ID NO: 8175 - RNA, 1617 nt, Artificial Sequence
  VP1__Norovirus_and/or_Norovirus-like__KX514172
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguauccccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagccccagucaggucaccauguucccccauauaauaguagauguuaggcaauuggaaccuguguugaucccuuuaccugauguuaggaauaacuucuaucauuacaaucagucaaaugauuccaccauuaaauugauagcaaugcuguauacaccacuuagggccaauaaugcuggggaugaugucuucacagucucuugucgaguccucacgaggccauccccugauuuugacuucauauuccugguaccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucucaaauuuacacaaugaauuuggccucuccaaauuggaacaauuaugacccaacagaagagaucccagccccucugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacugacacaacuaaugaucuugaugcucaccaaaacacaaaauucaccccagucggugucguccaggguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccucccaauggcuacuuuagguuugauuccuggguuaaucaauucuacacacuugcccccaugggaaauggaacggggcguaagcguuaa

SEQ ID NO: 8176 - RNA, 1617 nt, Artificial Sequence
  VP1__Norovirus_and/or_Norovirus-like__KX354114
augaagauggcgucgagugacgccaacccaucugauggguccgcagccaaccucgucccagaggccaacaaugagguuauggcuuuggagcccguugcuggugccgcccuugcggcaccuguagcgggucaacaaaauguaauugaccccuggauuagaaacaauuuuguacaagccccugguggagaguuuacaauauccccuagaaacgcuccaggugagauacuauggagcgcgcccuugggaccugaucugaaucccuaccuaucccauuuggccagaauguacaaugguuaugcaggugguuuugaagugcagguaauucucgcggggaacgcguucaccgccgggaaggucauauuugcagcagucccaccaaauuuuccaacuucaggcuugagccccagccaggucacuauguuccccaguguaguaguggauguuaggcaacuagaaccuguguugauucccuuacccgauguuaggaauaacuuuuaucauuauaaucaaucaaaugaccccaccaucacuuugauagcaauguuguacacuccacucagggcuaacaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaaggcuguucacgggccccagcagugccuuuguuguucaaccacaaaacggcaggugcacgacugauggcgugcuccuaggcaccacccaacugucuccugucaacauuugcaccuucagaggagauaucauccauaucacagguagucauaacuacacaaugaauuuggcuucucaaaauuggaacaauuaugacccaacagaagaaaucccagccccccuaggaacuccagacuuuguagggaagauucaaggcgugcucacccaaaccacaaggggggauggcucaacacgcggccacaaagccacaguguacacugggagcgccgauuuuauuccaaaacuggguagaguccaauuugaaacugacacaaaccaugauuuugaagcuaaccaaaacacaaaguucaccccagucggugucauccaagaugguagcaccacccaccgaaaugaaccccaacagugggugcucccaaguuacucaggcagaaacacucauaaugugcaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaagcuucauaaaucaggcuacauuacaguggcucacacuggccaacaugauuugguuauuccccccaaugguuauuuuagauuugauuccugggucaaccaguucuacacgcuugcccccaugggaaauggaacggggcguaaacguuaa

SEQ ID NO: 8177 - RNA, 1617 nt, Artificial Sequence
  VP1__Norovirus_and/or_Norovirus-like__KX514295
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugaaucccagccaggucacuauguucccccauauaauaguagauguuaggcaauuagaaccuguguugauccccuuaccugauguuaggaauaacuucuaucacuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuuuagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacugacacaacuaaugaucuugaugcucaccaaaacacaaaauucaccccagucggugucguccaggguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuugguuaucccccccaauggcuacuuuagguuugauuccuggguuaaucaauucuacacacuugcccccaugggaaauggaacggggcguaagcguuaa

SEQ ID NO: 8178 - RNA, 1617 nt, Artificial Sequence
  VP1__Norovirus_and/or_Norovirus-like__KX514242
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccacccacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauucaagguaugcucacucaaaccacaaagggagaagguucgacccggggccauagagcuacaguuuauguugggagugccaacuaugcuccaaagcuagguagaguucaauuugaaacugacacaacuaaugaucuugaugcucaccaaaacacaaaauucaccccagucggugucguccaggguggugaauccccccaacgaagugaaccccaacaaugggugcucccaaguuauucagguagagauaccccuaauguacaucuagccccugcuguagcccccacuuucccgggugaacaacuucuuuucuucagauccacuauacccgggugcggcgggcaccccaacauggauuuggacugccuacucccccaggagugggugcagcacuucuaccaagaggcagcuccagcacaaucugauguggcucuguugagauuugugaauccagacacgaguaggguccuguuugagugcaaacuucauaaaucagguuaugucacaguggcucacaccggucaacaugauuugguaaucccccccaauggcuauuuuagauuugauuccuggguuaaucaauucuacacacuugcccccaugggaaauggaacggggcguaagcguuaa

SEQ ID NO: 8179 - RNA, 1617 nt, Artificial Sequence
  VP1__Norovirus_and/or_Norovirus-like__KX514224
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaauguguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugccaacuaugcuccaaagcuagguagaguucaauuugaaacugacacaacuaaugaucuugaugcucaccaaaacacaaaauucaccccagucggugucguccaggguggugaauccccccaacgaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8180 - RNA, 1617 nt, Artificial Sequence
  VP1__Norovirus_and/or_Norovirus-like__KX514262
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcagugccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacugacacaacuaaugaucuugaugcucaccaaaacacaaaauucaccccagucggugucguccaggguggugaaucccccaaaggaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8181 - RNA, 1617 nt, Artificial Sequence
  VP1__Norovirus_and/or_Norovirus-like__KX354139
augaagauggcgucgagugacgccaacccaucugauggguccgcagccaaccucgucccagaggccaacaaugagguuauggcuuuggagcccguugcuggugccgcccuugcggcaccuguagcgggucaacaaaauguaauugaccccuggauuagaaacaauuuuguacaagccccugguggagaguuuacaauauccccuagaaacgcuccaggugagauacuauggagcgcgcccuugggaccugaucugaaucccuaccuaucccacuuggccagaauguauaaugguuaugcaggugguuuugaagugcagguaauucucgcggggaacgcguucaccgccgggaaggucauauuugcagcaguuccaccaaauuuuccaacuacaggcuugagccccagccaggucacuauguuccccaguguaguaguggauguuaggcaauuagaaccugugaugauucccuuacccgauguuaggaauaacuuuuaucauuacaaucaaucaaaugaccccaccaucacuuugauagcaauguuguacacuccacucagggcuaauaaugcuggggaugaugucuucacagucucuugccgaguucucacgagaccaucccccgauuuugauuucauauuucuagugccacccacaguugagucaagaacuaaaccauucucugucccaguuuuaacuguugaggagaugaccaauucaagauuccccauuccuuuggaaagacuguucacgggccccagcagugccuuuguuguucaaccacaaaacggcaggugcacaacugauggcgugcuccuaggcaccacccaacugucuccugucaacaucugcaccuucagaggggaugucacccacaucacagguagucgcaacuacacaaugaauuuggcuucucaaaauuggaacaacuaugacccaacagaagaaaucccagcuccucuaggaacuccagauuuuguggggaagauucaaggcaugcucacccaaaccacaagaacagaugguucaacgcgcggccacaaagcuacaguguacacugggagcgccgacuuugcuccaaaacuggguagaguucaauuugaaacugacacagaccaugauuuugaagcuaaucaaaacacaaaguucaccccagucggugucauccaagaugguagcaccacccaccggaacgaaccccaacagugggugcucccaaguuacucaggcagaaauacucacaauguacaucuggcccccgcuguagcccccaccuuuccgggugagcaaguuaucuucaucagauccaccaugcccggaagcagcggguaccccaacauggauuuggacugucugcucccccaggaaugggugcaguacuucuaccaagaggcagccccagcacaaucugauguggcuaugauaagauuugugaacccagacacagguaggguuuuguuugagugcaaacuccauaaaucaggcuacauuacaguggcucacacuggccaacaugauuugguuauuccccccaaugguuauuuuagauuugauuccugggucaaccaguucuacacacuugcccccaugggaaauggaacggggcguagacguuaa

SEQ ID NO: 8182 - RNA, 1617 nt, Artificial Sequence
  VP1__Norovirus_and/or_Norovirus-like__KX514215
augaagauggcgucgaaugacgucaacccaucugauggguccacagccaaccucgucccagaggucaacaaugagguuauggcuuuggagcccguugucggugccgcuaucgcggcaccuguagcgggccaacaaaauguaauugaccccuggauuagaaauaauuuuguacaagccccugguggagaguucacaguauccccuagaaacgcuccaggugaaauucuauggagcgcgcccuuagguccuggccugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugaaucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacaguuucuugucgaguccucacgaggccauccccugauuuugauuuuauauuccugguaccacccacaguugagucaagaucuaagcccuuuucugucccagucuuaacuguucaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugccaacuaugcuccaaagcuagguagaguucaauuugaaacugacacaacuaaugaucuugaugcucaccaaaacacaaaauucaccccagucggugucguccaggguggugaauccccccaacgaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8183 - RNA, 1617 nt, Artificial Sequence
  VP1__Norovirus_and/or_Norovirus-like__KX514367
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuagaaccuguguugauccccuuaccugauguuaggaauaauuucuaucacuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggcuucuccaaauuggaacaauuaugacccaacagaagagauuccagccccucugggaacuccagauuuugugggaaagauccaagguaugcucacucaaaccacaaagggagaagguucgacccggggccauagagcuacaguuuauguugggagugcugacuaugcuccaaagcuagguagaguucaauuugaaacugacacaacuaaugaucuugaugcucaccaaaacacaaaauucaccccagucggugucguccaggguggugaaucccccaaaggaagugaaccccaacaaugggugcucccaagucauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccucccaauggcuacuuuagguuugauuccuggguuaaucaauucuacacacuugcccccaugggaaauggaacggggcguaagcguuaa

SEQ ID NO: 8184 - RNA, 1617 nt, Artificial Sequence
  VP1__Norovirus_and/or_Norovirus-like__KX514243
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaaucuuguuguccaaccacagaauggcaggugcaugauugauggugugcucuuaggcaccacccaacugucuccuguuaacauuugcaccuucagaggggaugucacccacccuagggacucuccaauuuacacaaugaauuuggccucuccaaauuggaacaguuaugacccaacagaagaaacuccagccccccugggaacuccagacuuugugggaaagauccaugguaugcucacccaaaccacacagggaaguggcucgacccgggcccauagagcaacaguuuauguugggggugccgaauucacuccaaagcugggcaaaguucaauuuaaaacugaaacagaccaugaucuuucaauucgccaaaacacaaaauucaccccagucggugucguccaggguggugaauccccccaacgaagugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8185 - RNA, 1617 nt, Artificial Sequence
  VP1__Norovirus_and/or_Norovirus-like__KX353996
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguucacaguguccccuagaaacgcuccaggugaaauacuauggagcgcacccuuaggcccugauuugaaucccuaucuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaagucacuauguucccccacauaauaguagauguuaggcaauuggaaccuguguugauccccuuacccgauguuaggaauaacuuuuaccauuauaaucaaucaaaugacuccaccaucaaauugauagcaaugcuguacacaccacuuagggcuaauaaugccggggacgaugucuucacaguuucuugucgaguucucacgagaccaucccccgauuuugauuucauauuuuuggugccacccacaguugaaucaagaacuaaaccauucucugucccaguuuuaacuguugaggagaugaccaacucaagguuccccauuccuuuggaaaaauuguucacgggccccaguagugccuuuguuguucaaccacaaaacggcaggugcacgacugauggcgugcuccuagguaccacccaacugucuccugucaacaucugcaccuucagaggggaugucacccauauuccaggcagucguaacuacacaaugaauuuggccucccaaaauuggaacaguuacgauccaacagaagaaaucccagccccucuaggaacuccagauuucguggggaagauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucggcguuauccaggaugguaguacuaccccccgaaaugaaccccaacaaugggugcucccaaguuacucaggcagaaauacucauaaugugcaccuggcccccgcuguagcccccacuuucccgggcgagcagcuucucuucuucagaucuacuaugcccggaugcagcggguaccccaacauggacuuggaccgucugcccccccaggaacgggugcaguacuucuaccaggaggcagccccagcacaaucugauguagcucuguuaagauuugugaauccagacacagguaggguuuuguuugaguguaagcuucauaaaucaggcuauguuacaguggcucacacuggccaacaugauuugguuaucccccccaaugguuauuuuagauuugauuccugggucaaccaguucuacacacuugcccccaugggaaaugggacggggcguagacguuaa

SEQ ID NO: 8186 - RNA, 1617 nt, Artificial Sequence
  VP1__Norovirus_and/or_Norovirus-like__DQ078820
augaagauggcgucgaaugacgccagcccaucugauggguccacagccaaccucgucccagaggucaacaaugagguuauggcuuuggagcccguuguuggugccgcaauugcggcacccguagcgggccaacaaaauguaauugaccccuggauuagaaauaauuuuguacaagccccugguggagaguucacaguauccccuagaaacgcuccaggugaaauacuauggagcgcgcccuugggcccugaucugaaucccuaccuuucucauuuggccagaauguacaaugguuaugcagguggcuuugaagugcagguaauucucgcggggaacgcguucaccgcugggaaaaucauauuugcagcagucccaccgaauuuuccaacugaaggcuugggccccagccaggucaccauguucccccauauaauaguagauguuagacaacuggaaccuguguugauccccuuacuugauguuaggaauaaucucuaucacuauaaucagucaaaugacccuaccaucaaacugauagcaaugcuguacacaccacuuagggcuaauaaugcuggugaaguugucuucacagucucuugccgaguccucacgaggccaucccccgauuuugauuucauauuuuuggugccacccacaguugagucaagaacuaaaccauucaccgucccaauuuuaacugcugaggaaaugaccaauucaagauuccccacuccuuugggaaaguuguucacgggucccagcagugccuuuguuguucaaccacaaaauggcagaugcgcgacugauggcgugcucuuaggcacuacccaacugucuccugucaacaucugcaccuucagaggggaugucacccacauugcagguacucaugauuacacaaugaauuuggcuucccaaaauuggaacaauuaugacccaacagaagaaaucccagccccucugggaacuccagauuucgugggaaagauccaaggcgugcucacucaaaccacaaggggagauggcucgacccguggccacaaagcuacagugagcacugggaguguccacuuuacuccaaagcugggcgguguucaauucaccacugauacaaauaaugauuuugaaacuggccaaaacacgaaauucaccccagucggugucauccaggauggcaauagcacccaccaaaaugaaccccaacaaugggugcucccaaauuacucagguagaacuggccauaauguacaccuagccccugcuguagcccccacuuuuccgggugagcaacuucuuuucuucagguccacuaugcccggaugcagcggguaucccaacaugaauuuggauugccuacucccccaggaaugggugcagcacuucuaccaagaggcagcuccagcacaaucugauguggcucugcugagauuugugaauccagacgcagguaggguccuguuugagugcaaaccucauaaaucaggcuaugucacaguggcucacacuggccagcaugauuugguuaucccccccaauggcuauuuuagauuugauuccuggguuaaccaauucugcacacuugcccccaugggaaauggaacggggcguagacguuaa

SEQ ID NO: 8187 - RNA, 1617 nt, Artificial Sequence
  VP1__Norovirus_and/or_Norovirus-like__AB933738
augaagauggcgucuaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguucacaguauccccuagaaacgcuccaggugaaauacuauggagcgcgcccuuaggcccugauuugaaucccuaccuuuucccauuggccagaaaggucaaagguuaugcaggggguuuugaagugcagguaauucuugcggggaaagcguuccccgccgggaaaaucauauuugcagcauccccacccaauuuuccaacugaaggcuugagucccagccaggucacuauguucccccauauaauaguggauguuaggcaauuggaaccuguguugauccccuuaccugauguuaggaauaacuucuaucauuauaaucaaucaaaugacuccaccaucaaauugauagcaauguuguauacaccacuuagggcuaauaaugcuggggaagaugucuucacagucucuugucgaguucuuacgagaccaucccccgauuuugauuucauauuuuuggugccacccacaguugagucaagaacuaaaccauucucugucccaauuuuaacuguugaagaaaugaccaauucaagguuccccauuccuuuggaaaaguuguucacgggucccaguaguaccuuuguuguucaaccacaaaacggcaggugcacgacugauggcgugcucuuaggcacuacccaacugucuccugucaacaucugcaccuuuagaggggaugucacccacauugcaggcucucguaauuacacaaugaauuuggcuucucaaaauuggaacaguuaugacccaacagaagaaaucccagccccucuaggaacuccagauuucguggggaagauucaaggugugcucacccaaaccacaaggagagaugguucgacccgcggccacaaagcuacaguguacacugggagugccgacuuuucuccaaaacuggguagaguucaauuugccacugacacagacaaugauuuugauacucaccaaaacacaaaguucaccccagucgguguuauccaggauggugguacugcccaccgaaaugaaccccaacaaugggugcucccaaguuacucaggcagaaauacucauaaugugcaccuggccccugcuguagcccccacuuucccgggugagcaacuccucuucuucagaucuacuaugcccggaugcagcggguaccccaacauggauuuggauugucugcuuccccaggagugggugcaguauuucuaccaagaagcagccccagcacaaucugauguggcucugcuaagauuugugaauccagacacagguaggguuuuguuugaguguaagcuucauaaaucaggcuauguuacaguggcccacaccggccaacaugauuugguuaucccccccaaugguuauuuuagauuugauuccugggucaaccaguucuacacacuugcccccaugggaaauggaacggggcguagacguuaa

SEQ ID NO: 8188 - RNA, 1617 nt, Artificial Sequence
  VP1__Norovirus_and/or_Norovirus-like__EU780734
augaagauggcgucgaaugacgccaccccaucugauggguccacagccaaccucgucccagaggucaacaaugagguuauggcuuuggagcccguuguuggcgccgcgauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguuuccccauauaauaguagauguuaggcaacuggaaccuguguugauccccuugccugauguuaggaacaauuucuaucauuacaaucaaucaaaugaccccaccaucaaauugauagcaaugcuguauacaccacuuagggcuaacaaugcuggggacgaugucuucacagucucuugucgaguucucacgagaccaucccccgauuuugauuucauauuuuuggugccacccacaguugagucaagaacuaaaccauucucugucccaaucuuaacuguugaggagaugaccaauucaagauucccuauuccuuuggaaaaguuguucacgggucccagcagugccuuuguuguucaaccacaaaauggcagaugcacgacugauggcgugcucuuagguacuacccaacugucuccugucaacaucuguaccuucagaggggaugucacccacauugcagguacucaaaauuacacaaugaaucuggccucccaaaauuggaacaauuaugacccaacagaagaaaucccagccccucugggaaccccagauuuuguaggaaagauccaaggcgugcucacccaaaccacaaggagggauggcucgacccgcggucacaaagccacagugagcacuggaaguauccacuucacccaaagcugggcaguguucaauucuccacugauacaagcaaugacuuugaaacuggccaaaacacgagauucaccccagucgguugucguccaggaugguaguaccacccaccaaaaugaaccccaacaaugggugcucccagacuauucagguagagauaguuacaauguacaccuagccccugccguggcccccacuuuuccgggugagcaacuucuuuucuuuagguccaccaugcccggaugcagcggguaucccaacaugaauuuggauugccuacucccccaggagugggugcagcacuucuaccaagagucagccccagcacaaucugauguggcgcugcugagauuugugaauccagacacagguaggguuuuguuugaguguaagcuucauaaaucaggcuauguaacaguggcucacacuggccaacaugauuugguuaucccccccaauggcuauuuuagauuugauuccugggucaaccaauucuauacacuugcccccaugggaaauggagcggggcguagacguuaa

SEQ ID NO: 8189 - RNA, 1617 nt, Artificial Sequence
  VP1__Norovirus_and/or_Norovirus-like__KP064096
auggcgucuaaggacgccccaacaaacauggauggcaccaguggugccggccagcugguaccagaggcaaacacagcugagccuauaucaauggagcccguggcuggggcaguaacagcugccgcaaccgcuggccaaguuaauaugauugaccccuggauaaugaauaauuaugugcaagccccucaaggugaauucaccauaucgccuaacaacacaccaggugacauuuuguuugauuuacaauuaggcccccaccuuaacccuuucuugucccaucuggcccaaauguauaauggcuggguuggcaauaugaaagugaggguuuuauuggcugguaaugccuucacggcugguaaaauaauuauuagcugcauacccccuggcuuuguugcacaaaacauuucuaucgcucaggcuacuauguucccccaugucauagcugauguuagaguuuuggaacccauugaggugccauuggaagaugugaggaaugugcuguuccauaacaaugauaacacaccaaccaugagguuggugugcauacucuacacccccuugcgagccagugguagcucgucuggaacugaccccuuugugauugcugggcgugucuuaacaugcccgagcccugauuuuagcuuuuuguuuuuggucccccccaauguagaacaaaagacuaaaccuuuuagugucccaaaucuuccauugaauacccuuucaaauucgagagucccuucucuaauuaaaucaaugaugguauccagggaccaugggcagaugguucaguuucaaaaugguagggucacucuagaugggcaacugcaaggcaccacgcccacaucagcuagccagcugugcaaaaucagaggcagugucuuccaugcuaauggugggaauggguauaaccugacagaacuggaugggagcccauaccaugcauuugagagccccgcaccaauaggauuuccagaucuaggugaaugugacuggcacauggaggcuucuccuaccacccaauucaauacuggcgauguuauaaaacaaauuaaugucaaacaagaaucagcauuugccccccaccuugguacuauacaggcagacggccugagugaugugagugucaacaccaacaugauagcuaaauuaggaugggugucacccgucagugauggacacaaaagagaugucgacccgugggucaucccacgcuaugggucgacuuugacugaggccgcccaauuagccccuccaauauaucccccagguuuuggugaggccauuguguuuuucaugucagauuuuccuauugcccaugguaccaauggcuugagugugccuuguaccauaccccaagaguucgucacucauuuugucaaugaacaggccccuacuagaggggaagcagcccuauuacauuauuuggacccugacacucauaggaaucuuggugaauuuaaauuauauccugauggcuucaugacgugugugccuaauaccagcggcacugguccacaaacucuuccaaucaauggugucuuuguuuuuguguccugggucuccagauuuuaucaauuaaagccugugggaacagccggcccggcucguaggcuuuaa

SEQ ID NO: 8190 - RNA, 1617 nt, Artificial Sequence
  VP1__Norovirus_and/or_Norovirus-like__KC473548
augaugauggcgucuaaggacgccccaacaaacauggauggcaccaguggugccggucagcugguaccagaggcaaauacggcugaaccuuuaccaauaaaaccaguggccggggcugcgacugcgguugcaaccgccggucagguaaauaugauugaccccuggauaaugaacaauuuuguacaggcuccccaaggggaguuuaccauuuccccaaauaauacaccuggugauauuuuauuugauuugcaauuaggaccacaucuuaauccuuucuuggcucauuugucuagaauguauaaugguuggguugggaauaugcagguccgcauaaugcuugcugguaaugccuuuucagcuggaaagauuauugugugcugcauaccgccggguuuuucuucucaaucuauuucuauugcucaagcuacaauguucccacaugucauagcugaugucagaguguuagaaccuauugauguacccuuagaugauguuagaaauguccuuuuucauaauaaugauaacccccaaacgaugagauugcuuugcauguuguauacaccccuucggucuggugguacaucuucagguacagauccuuuugucauugcuggucgugucuugaccugccccacaccugauuuuaguuucuuguuccuugucccuccugauaucgagcaaagaacuaagcccuucaguguacccaauaucccuaugaaccugauguccaauucccguguuucaauguugauugaugguaugaugguuucaaaugaucagaaucaagucccccaguuucagaauggucgagucacuuuagauggacagcugcaggguaccaccacaguuucagcugcguguguagcaaggaugagggggcgcauuuuuaauaauaauggcaauuauggugugaaucugacugaacuggauggcaaucccuaucaugccuuugauagcccggcuccuuuaggcuuuccugacuuugggaauugugauuugcacaugaccuuuguuaaaauuaaucccaaugaguuguccucuggagacccuucuggcaaaguggucauucguuccuacgaugccacuuuugccccccaucuugguacugucaaacuggagaaugaugaugagcuagcucgguuuguggguaaggagguaguacuggagcugacguggguuuccaacagagagggugccacccuuaaucuaugggcuguuccaaauuaugguuccaguuugacacaggcgucacagcuugccccaccaauuuaccccccuggguuuggugaggcuauuguguauuucaccucuacuuuuccaacagucagcaacccaaaagucccauguacacuuccucaagaauuuguuucacauuuugucaaugaacaggcccccacacgcggcgaugccgcucuucuucauuauguugauccugacacacaccguaaucuuggagaguuuaagauguacccugagggcuacaugacaugugucccuaaugcugguggugggccacaaaccuuaccaaucaaugguguauuugucuucauuucuuggguuucuagauauuaccaguuaaagccugugggaacugccggugcggcuaggaggcuuuaa

SEQ ID NO: 8191 - RNA, 1617 nt, Artificial Sequence
  VP1__Norovirus_and/or_Norovirus-like__AB684698
auggcgucuaaggacgccccuucaaacauggauggcaccaguggugcuggccagcugguuccagaggcaaauacagcugagccaauaaauauggaaucuguagugggugcugcuacugcaacugccacugcagggcaaguuaauuugauugaccccuggauuaugaauaauuaugugcaagccccucagggcgaauuuacaaucucaccaaauaauaccccuggggauguuuuguuugaucugcaacuuggaccacaucuaaacccuuuccuuucccaccuaucuagaauguacaaugguuggguugguaauaugaaagugagagucauguuggcaggcaaugccuucucugcuggaaagauuauuaucuguuguaucccuccuggauucacaucacaaaguauuucuauagcacaggcuacuauguucccccaugugauugcugauguucgugucuuggaaccuauugauguaccucuugaugaugucagaaauguucucuuccauaauaaugauaacgcgcagacaaugagguuguuguguaugcuguacaccccccucagaacuggagcgucuucuucuggaucugaccccuuugugauugcuggccggguguuaaccugucccacucaagauuuuaauuuucuuuuccuaguccccccagauguggagcagaaaaccaaacccuuuagugucccaaauauaccccuuaaucugauguccaauucuagggucccagcuuugauugaugguaugacaguuuccagugaucaaaaucagguggugcaguuccaaaauggcagggucacucuggauggacaauugcagggcacuacugcagucucggcuucaugcguggcgaagauuagaggccgcauuuucuccaacgccucccauuacggcauaaauuugacugaagucgauggcacccaauaucaugccuuugacaguccugcaccccuugguuuuccagacuuuggcaauugugauuggcaugugacaggcaccaaagcaagucagggugaccuucagacugacaacccuacuauaucuggcaccaucaaaucauaugaguccucuuuugccccccacuugggaacagugagaauugagggagaugauaaugaguuagcaagauucaaugguaaggauguucuucucaaccugacaugguucucucagaggaauggcucucaauuaaauuuguggacaaucccuucauauggcucuaaucuuacugaagcuucacaauuggcgccaccuauauacccaccaggguuuggugaagcaauagucuacuuuacuucaacauucccugcgauuagcaggcccagugugccaugcaccaugccccaagaguuugucucucacuuuguuaaugagcaagccccuacuaggggugaggcugcacuccuccauuaucuugauccugauacucauagaaauuugggggaauucaaaauguacccugaaggguucuucaccuguguucccaaugcgggugguaguggcccccaaacucuuccaauaaaugguguuuuugucuuugugucaugggugucuagguauuaucaauugaagccagugggaacugucggcaugacaaggaggcuuuaa

SEQ ID NO: 8192 - RNA, 1617 nt, Artificial Sequence
  VP1__Norovirus_and/or_Norovirus-like__AF538679
augaagauggcgucuaaggacgccccaacaaacauggauggcaccaguggugccggucagcugguaccaggggcaaauacagcugaaccuuuaccaauaaaaccaguggccggggcugcgacugcgguugcuacugccggccaggugaauaugauugaccccuggauaaugaauaauuuuguacaggcuccccaaggggaguuuacuauuuccccaaauaauacaccuggugauauuuuguuugauuugcaacuagggccucaucuuaacccuuucuuggcucauuuaucuagaauguacaauggcuggguugggaauaugcagguccgcauaaugcuugcugguaaugcuuuuucagcuggaaagauuauuguguguugcauaccgccaggcuuuucuucucaaucuauuucuauugcucaagcuacaauguucccgcacguuauagcugauguuagaguguuagaacccauugaugugcccuuagaugauguuagaaauguccuuuuucacaauaaugauaacccccaaacgaugagauugcuuugcauguuguauacgccccuucggucugguggugcaucuucagguacagacccuuuugucauugcuggucgugucuugaccugccccacaccugauuuuaguuucuuguuccuuguccccccugauaucgagcaaagaaccaagccauuuaguguucccaauauccccaugaaucugauguccaacucccguguuccaauguugauugaugguaugaugguuucaaaugaucagaaucaagucccccaauuucaaaaugggcgagucacuuuagaugggcaguugcagggcaccaccacaguuucagcugcauguauagcaaggaugaggggacgcauuuuuaauaacaaugguaauuauggugugaaucuggcugaauuggaugguaauccuuaucaugccuuugauaguccagcuccuuuagguuuuccugauuuuggaaauugugauuugcauaugaccuuuguuaagauuaaucccacugaguuguccacuggagauccuucugguaagguggucauccauucuuacgaugccacuuuugccccccaccuuggcacagucaaacuggaggauaauaaugaguuagaucaguuugugggcaaggaaguggugcuggagcugacguggguuuccaauagaacgggugccacccucaaucuaugggccguuccaaauuacggcuccaauuugacucaggcgucacagcuugccccgccaauuuaucccccuggauuuggcgaagcuauuguguauuuuaccuccacauuuccaacggucaguaacccaaaaguuccauguacccuuccucaagaauuuguuucacauuuugucaaugaacaggcucccacacgcggugaugcugcucuccuucauuauguugauccugacacacaucguaaucuuggggaauuuaagauguauccugagggcuacaugacaugugucccuaaugcugguggugggccacaaacucugccaaucaaugguguguuuguuuucauuucuugggucucuagauauuaucaguuaaagccugugggaacugccggugcggcuaggaggcuuuaa

SEQ ID NO: 8193 - RNA, 1617 nt, Artificial Sequence
  VP1__Norovirus_and/or_Norovirus-like__JQ743332
augaugauggcgucuaaggacgccucucaaagcgcugauggcgcaagcggcgcaggucaacuggugccggagguuaauacagcugaccccuuacccauggaacccguggcugggccaacaacagccguagccacugcugggcaaguuaauaugauugaucccuggauuguuaauaauuuuguccagucaccacaaggugaguuuacaauuuccccuaauaauacccccggugauauuuuguuugauuuacaauuagguccacaucuaaacccuuucuugucacauuugucccaaauguauaauggcuggguuggaaacaugagaguuaggauucuccuugcugggaaugcauuuucagccggaaagauuauaguuuguuguguccccccuggcuucacaucuuccucucucaccauagcucaggcuacauuguuuccccaugugauugcugaugugagaacccuugaaccaauagaaaugccucucgaggauguacgcaauguccucuaucacaccaaugauaaucaaccaacuaugcgguugguguguaugcuguacacgccgcuccgcacugguggugggucugguaauucugauucuuuugugguugcuggcagggugcucacggccccuaguagcgacuucaguuucuuguuccuugucccgccuaccauagaacagaagacucgggcuuuuacugugccuaauauccccuugcaaaccuuguccaauucuagguuuccuucccucauucaggggaugauucuguccccugacgcaucucaagugguccaauuccaaaauggacguugucuuauagauggucaacuccuaggcacuacacccgccacaucaggacaguuguucaggguaagaggaaagauaaaucagggagcccgcacacucaaccucacagagguggauggcaaaccauucauggcauuugauuccccugcaccugugggguuccccgauuuuggaaaaugugauuggcacaugagaaucagcaaaaccccaaauaacacaagcucaggugacccuaugcgcagugucagcgugcaaaccaaugugcaggguuuugugccacaccuggggaguauacaguuugaugaaguguucaaccaccccacaggugacuacauuggcaccauugaauggauuucccagccaucuacacccccuggaacagauaucaaucugugggagauccccgauuauggaucaucccuuucccaagcagcuaaucuggcccccccaguauuccccccuggauuuggugaggcucuuguguacuuuguuucugcuuuuccaggccccaacaaccgcucagccccgaaugaugugccaugucuccucccucaagaguacauaacccacuuugucagugaacaagccccaacgaugggugacgcagcuuugcugcauuaugucgacccugauaccaacagaaaccuuggggaguucaaguuauacccuggagguuaccucaccuguguaccaaacggggugggugccgggccucaacagcuuccccuuaauggugucuuucucuuugucucuugggugucucguuuuuaucagcucaagccugugggaacagccaguacggcaagauaa

SEQ ID NO: 8194 - RNA, 1617 nt, Artificial Sequence
  VP1__Norovirus_and/or_Norovirus-like__GQ856470
augaugauggcgucuaaggacgccccaacaaacauggauggcaccaguggugccggucagcugguuccagagguuaguacagcugaaccuauaucaauggaaccuguagcuggugcugccacagcagcagcaacugcaggucaaguuaauaugauugaccccuggauuaugaguaauuauguucaagccccucaaggagaguucacaauuuccccuaacaauacccccggagacauauuguuugauuuacaauuagguccccaucuaaacccguuucuaucacaccuggcccagauguacaauggguggguuggcaauaugaaaguuagggugcugcuugcugguaaugcauuuacagcaggcaaaauaauaaucaguugugucccuccagguuuugcagcccagaauguuucaauagcccaagcuacuauguucccccauguuauugcagaugugcgagugcuugaaccaauugaagucccacuagaggaugugaggaaugugcuuuuccacaacaaugauuccaccccaacuaugagauugauuuguauguuguacaccccucuccgugcuagugguaguucuucuggcacugauccauuuguuauagcuggucggguccucaccuguccuaguccugacuucaacuucuuauuccuuguccccccuaacguugaacagaaaaccaagccauucagugugcccgaucucccccuuaauguucucucaaacucuaggguccccuccuugauaaaguccaugauggucucccaagaucauggacagaugguacaauuccaaaauggcaggguuacauuagauggacagcuccaaggcaccacccccacuucagcuagccagcucugcaaaauucgagggacggucuaccaugcaacugguggacaagggcuuaauuuaacugaaauugaugggacccccuaccaugcauuugagagcccugccccaauuggcuuccccgauuuaggugagugugauuggcacauuaaugcauccccugccaaugccuucacagaugguagcauuauacacagaauugauguaguucaggauccuacuuuugccccccaucuaggcacuauccacuauacuaaugcuaauuaugaugcuaauguuagccugaucuguucacuugaauggcuuuccccaccaagugguggugcucuaaaagcaaacccaugggccauuccucgguauggcucaacccugacugaggccgcccaauuggccccaccaauauaccccccuggcuuuggugaggcaauuguuuucuuuaugucugauuucccuauagcuaaugguucagauggucugaguguccccugcacuauaccacaagaguuugugacucacuuuguuaaugaacaagcaccaacccguggggaagcugcccuccuucauuauguugacccugacacacaccgcaaucuaggugaguuuaaauuauauccugaaggguucaugaccugcguaccaaauucuagugguagugguccccaaacacugcccaucaauggggucuucacuuucaucucuuggguuucccguuucuaccaacuaaagccugugggaacgaccggaccgguucguaggcucuaa

SEQ ID NO: 8195 - RNA, 1617 nt, Artificial Sequence
  VP1__Norovirus_and/or_Norovirus-like__JN603244
augaugauggcgucuaaggacgccccaacaaacauggauggcaccaguggugccggucagcugguuccagagguuagcacagcugaaccuauaucaauggaaccuguggcuggugcugccacagcagcagcaaccgcaggucaaguuaauaugauugaccccuggauuaugaguaauuauguucaagccccucaaggagaguucacaauuuccccuaacaauacccccggagacauauuguuugauuuacaauuaggcccccauuuaaacccauuccuaucacaccuggcccagauguacaauggguggguuggcaauaugaaaguuagggugcugcucgcugguaaugcauuuacagcgggcaaaauaauaaucaguuguguccccccagguuuugcagcccagaauguuucaauagcccaagcuacuauguucccccauguuauugcagaugugcgagugcuugaaccaauugaagucccacuagaggaugugaggaaugugcuuuuccauaauaaugauucuaccccaacuaugagauugauuuguauguuguauaccccucuccgugcuagugguaguucuucuggcacugauccauuuguuauagcuggucggguccucaccugucccaguccugacuuuaacuuuuuguuccuuguccccccuaauguugaacagaaaaccaagccauuuagugugcccaaucucccccuuaauguucucucaaacucuaggguucccucucugauaaaguccaugauggucucccaagaccauggacagaugguacaauuccaaaaugguaggguuacauuagauggacagcuccaagguaccacccccacuucagcuagucagcucugcaaaauucgagggacgguuuaccaugcaacugguggucaagggcuuaauuuaacugaaauugaugggacccccuaccaugcauuugaaagcccugccccaauuggcuuccccgauuuaggugagugugauuggcacauuaacgcaucuccugcuaaugcuuucacagaugguaguauuauacauagaauugauguagcucaggauucuacuuuugccccccaucuaggcacuauccauuauacuaaugcugauuauaaugcuaauguuggccugauuuguucacuugaauggcuuuccccaccaagugguggugcuccaaagguaaauccgugggcuauuccucgguaugguucaacucugacugaggccgcccaacuggccccaccaauauacccccccgguuuuggugaggcaauuguuuucuuuaugucugauuuccccauagcuaaugguucagauggucugaguguucccugcacuauaccacaagaguuugugacccacuuuguuaaugaacaagcaccaacccguggggaagcugcccuccuucauuauguugacccugacacacaccgcaaucuaggugaguuuaaacuauacccugaaggauucaugaccuguguaccaaauucuagugguaguggcccccaaacacugcccaucaauggggucuucacuuucaucucuuggguuucccguuucuaucaacuaaagccugugggaacgaccggaccgguucguaggcucuaa

SEQ ID NO: 8196 - RNA, 1617 nt, Artificial Sequence
  VP1__Norovirus_and/or_Norovirus-like__AB078335
augaugauggcgucuaaggacgccccucaaagcgcugauggcgcaagcggcgcaggucaacuggugccggagguuaauacagcugaccccuuacccauggaacccguggcugggccaacaacagccguagccacugcugggcaaguuaauaugauugaucccuggauuguuaauaauuuuguccagucaccacaaggugaguuuacaauuuccccuaauaauacccccggugauauuuuguuugauuuacaauuagguccacaucuaaacccuuucuugucacaucugucccaaauguauaauggcuggguuggaaacaugagaguuaggauucuccuugcugggaaugcauucucagcuggaaagauuauaguuuguuguguccccccuggcuuuacaucuuccucucucaccauagcucaggcuacauuguuuccccaugugauugcugaugugagaacccuugaaccaauagaaaugccccucgaggauguacgcaauguccucuaucacaccaaugauaaucaaccaacaaugcgguugguguguaugcuguacacgccgcuccgcacugguggggggucugguaauucugauucuuuugugguugcuggcagggugcucacggccccuaguagcgacuucaguuucuuguuccuugucccgccuaccauagaacagaagacucgggcuuuuacugugccuaauauccccuugcaaaccuuguccaauucuagguuuccuucccucauccaggggaugauucugucuccugacgcaucucaagugguccaauuccaaaauggacguugccucauagauggucaacuccuaggcacuacacccgcuacaucaggacagcuguucagaguaagaggaaagauaaaucagggagcccguacgcucaaccucacagagguggauggcaaaccauucauggcauuugauuccccugcaccugugggguuccccgauuuuggaaaaugugauuggcacaugagaaucagcaaaaccccaaauaacacaagcucaggugaccccaugcgcagugucagcgugcaaaccaaugugcaggguuuugugccacaccuaggaaguauacaguuugaugaaguguucaaccaccccacaggugacuacauuggcaccauugaauggauuucccagccaucuacacccccuggaacagauauuaaucugugggagauucccgauuauggaucaucccuuucccaagcagcuaaucuggcccccccaguauuccccccuggauuuggugaggcucuuguguacuuuguuucugcuuuuccaggccccaacaaccgcucagccccgaaugauguaccuugucuucucccucaagaguacauaacccacuuugucagugaacaagccccaacgaugggugacgcagcuuugcugcauuaugucgacccugauaccaacagaaaccuuggggaguucaagcuauacccuggagguuaccucaccuguguaccaaacggggugggugccgggccucaacagcuuccucuuaauggugucuuucucuuugucucuugggugucucguuuuuaucagcucaagccugugggaacagccaguacggcaagauaa

SEQ ID NO: 8197 - RNA, 1617 nt, Artificial Sequence
  VP1__Norovirus_and/or_Norovirus-like__GU299761
augaugauggcgucuaaggacgccccaacaaacauggauggcaccaguggugccggucagcugguaccagaggcaaauacagcugaaccuuuaccaauaaaaccaguggccggggcugcgacugcgguugcaaccgccggucagguaaauaugauugaccccuggauaaugaauaauuuuguacaggcuccccaaggggaguuuaccauuuccccaaauaauacaccuggugauauuuuauuugauuugcaauuaggaccacaucuuaauccuuucuuggcucauuugucuagaauguauaaugguuggguugggaauaugcagguccgcauaaugcuugcugguaaugccuuuucagcuggaaagauuauugugugcugcauaccgccggguuuuucuucucaaucuauuucuauugcucaagcuacaauguucccacaugucauagcugauguuagaguguuagaaccuauugauguacccuuagaugauguuagaaauguccuuuuucauaauaaugauaacccccaaacgaugagauugcuuugcauguuguauacaccccuucggucuggugguacaucuucagguacagauccuuuugucauugcuggucgugucuugaccugccccacaccugauuuuaguuucuuguuccuugucccuccugauaucgagcaaagaacuaagccauucaguguacccaauaucccuaugaaccugauguccaauucccguguuucaauguugauugaugguaugaugguuucaaaugaucagaaucaagucccccaguuucagaauggucgagucacuuuagauggacagcugcaggguaccaccacaguuucagcugcguguguagcaaggaugaggggacgcauuuuuaauaauaauggcaauuauggugugaaccugacugaacuggauggcaauccuuaucaugccuuugauagcccggcuccuuuaggcuuuccugacuuugggaauugugauuugcacaugaccuuuguuaaaauuaaucccaaugaguuguccucuggagacccuucuggcaaaguggucauucauuccuacgaugccacuuuugccccccaucuugguacugucaaacuggagaaugaugaugagcuagcucgguuuguggguaaggagguaguacuggagcugacguggguuuccaacagagagggugccacccuuaaucuaugggcuguuccaaauuaugguuccaguuugacacaggcgucacagcuugccccaccaauuuaccccccuggguuuggugaggcuauuguguauuucaccucuacuuuuccaacagucagcaacccaaaagucccauguacacuuccucaagaauuuguuucacacuuugucaaugaacaggcccccacacgcggcgaugccgcucuucuucauuauguugauccugacacacaccguaaucuuggagaguuuaagauguacccugagggcuacaugacaugugucccuaaugcugguggugggccacaaaccuuaccaaucaaugguguauuugucuucauuucuuggguuucuagauauuaccaguuaaagccugugggaacugccggugcggcuaggaggcuuuaa

SEQ ID NO: 8198 - RNA, 1617 nt, Artificial Sequence
  VP1__Norovirus_and/or_Norovirus-like__AJ277610
augaugauggcgucuaagggcgccccucaaagcgcugauggcucaagcggcgcaggucaacuggugccggagguuaauacagcugaccccuuacccauggaacccguggcugggccaacaacagccguagccacugcugggcaaguuaauaugauugaucccuggauuguuaauaauuuuguccagucaccacaaggugaguuuacaauuuccccuaauaauacccccggcgauauuuuguuugauuuacaauuagguccacaucuaaacccuuucuugucacauuugucccaaauguauaauggcuggguuggaaacaugagaguuaggauucuucuugcuggaaaugcauucucagcuggaaagauuauaguuuguuguguccccccuggcuuuacaucuuccucucucaccauagcucaggcuacauuguuuccccaugugauugcugaugugagaacccuugaaccaauagaaaugccucucgaggauguacgcaauguccucuaucacaccaaugauagucaaccaacaaugcgguugguguguaugcuguacacgccgcuccgcacuggugggggaucugguaauucugauucuuuuguaguugcuggcagggugcucacggccccuaguagcgacuucaguuucuuguuccuugucccgccuacuauagaacagaagacucgggcuuuuacugugccuaauauccccuugcaaaccuuguccaauucuagguuuccuucccucauccaggggaugauucuguccccugacgcaucucaagugguccaauuccaaaauggacguugccuuauagauggucaacuccuagguacuacacccgcuacaucaggacaguuguucagaguaagaggaaagauaaaucagggagcccgcacacucaaccucacagagguggauggcaaaccauucauggcauuugauuccccugcaccugugggguuccccgauuuuggaaaaugugauuggcacaugagagucagcaaaaccccaaauaacacaagcucaggugaccccaugcgcagugucagcguacaaaccaacgugcaggguuuugugccacaccugggaaguauacaguuugaugaaguguucaaccaccccacaggugacuacauuggcaccauugaauggauuucccagccaucuacaccccuugggacagauauuaaucugugggagauucccgauuauggaucaucccuuucccaagcagcuaaucuggcccccccaguauuccccccuggauuuggugaggcucuuguguacuuuguuucugcuuuuccaggccccaacaaccguucagccccgaaugauguaccuugucuucucccucaagaguacauaacccacuuugucagugaacaagccccaacgaugggugacgcagcuuugcugcauuaugucgacccugacaccaacagaaaccuuggggaguucaagcuauacccuggagguuaccucaccuguguaccgaacggggugggugccgggccucaacagcuuccucuuaauggugucuuucucuuugucucuugggugucucguuuuuaucagcucaagccugugggaacagccaguacggcaagauaa

SEQ ID NO: 8199 - RNA, 1617 nt, Artificial Sequence
  VP1__Norovirus_and/or_Norovirus-like__GQ856462
augaugauggcgucuaaggacgccccaacaaacauggauggcaccaguggugccggucagcugguaccagaggcaaauacagcugaaccuuuaccaauaaaaccaguggccggggcugcgacugcgguugcaaccgccggucagguaaauaugauugaccccuggauaaugaauaauuuuguacaggcuccccaaggggaguuuaccauuuccccaaauaauacaccuggugauauuuuauuugauuugcaauuaggaccacaucuuaauccuuucuuggcucauuugucuagaauguauaaugguuggguugggaauaugcagguccgcauaaugcuugcugguaaugccuuuucagcuggaaagauuauugugugcugcauaccgccggguuuuucuucucaaucuauuucuauugcucaagcuacaauguucccacaugucauagcugauguuagaguguuagaaccuauugauguacccuuagaugauguuagaaauguccuuuuucauaauaaugauaacccccaaacgaugagauugcuuugcauguuguauacaccccuucggucuggugguacaucuucagguacagauccuuuugucauugcuggucgugucuugaccugccccacaccugauuuuaguuucuuguuccuugucccuccugauaucgagcaaagaacuaagccauucaguguacccaauaucccuaugaaccugauguccaauucccguguuucaauguugauugaugguaugaugguuucaaaugaucagaaucaagucccccaguuucagaauggucgagucacuuuagauggacagcugcaggauaccaccacaguuucagcugcguguguagcaaggaugaggggacgcauuuuuaauaauaauggcaauuauggugugaaccugacugaacuggauggcaauccuuaucaugccuuugauagcccggcuccuuuaggcuuuccugacuuugggaauugugauuugcacaugaccuuuguuaaaauuaaucccaaugaguuguccucuggagacccuucuggcaaaguggucauucauuccuacgaugccacuuuugccccccaucuugguacugucaaacuggagaaugaugaugagcuagcucgguuuguggguaaggagguaguacuggagcugacguggguuuccaacagagagggugccacccuuaaucuaugggcuguuccaaauuaugguuccaguuugacacaggcgucacagcuugccccaccaauuuaccccccuggguuuggugaggcuauuguguauuucaccucuacuuuuccaacagucagcaacccaaaagucccauguacacuuccucaagaauuuguuucacauuuugucaaugaacaggcccccacacgcggcgaugccgcucuucuucauuauguugauccugacacacaccguaaucuuggagaguuuaagauguacccugagggcuacaugacaugugucccuaaugcugguggugggccacaaaccuuaccaaucaaugguguauuugucuucauuucuuggguuucuagauauuaccaguuaaagccugugggaacugccggugcggcuaggaggcuuuaa

SEQ ID NO: 8200 - RNA, 1617 nt, Artificial Sequence
  VP1__Norovirus_and/or_Norovirus-like__AF435807
augaagauggcgucuaaggacgccccucaaagcgcugauggcgcaagcggcgcaggucaacuggugccggagguuaauacagcugaccccuuacccauggaacccguggcugggccaacaacagccguagccacugcugggcaaguuaauaugacugaucccuggauuguuaauaauuuuguccagucaccucaaggugaguuuacaauuuccccuaauaauacccccggugauauuuuguuugauuuacaauuagguccacaucuaaacccuuucuugucacauuugucccaaauguauaauggcuggguuggaaacaugagaguuaggauucuccuugcugggaaugcauucucagcuggaaagauuauaguuuguuguguccccccuggcuuuacaucuuccucucucaccauagcucaggcuacauuguuuccccaugugauugcugaugugagaacccuugaaccaauagaaaugccucucgaggauguacgcaauguccucuaucacaccaaugauaaucaaccaacaaugcgguugguguguaugcuguacacgccgcuccgcacugguggggggucuggugauucugacucuuuugugguugcuggcaaggugcucacagccccuaguagcgacuucaguuucuuguuccuugucccgccuaccauagaacagaagacucgggcuuuuacugugccuaauauccccuugcaaaccuuguccaauucuagguuuccuucccucauccaggggaugauucugucccccgacgcaucucaagugguccaauuccaaaaugggcguugccuuauagauggucaacucuuaggcacuacacccgcuacaucaggacagcuguucagaguaagaggaaagauaaaucagggugcccgcacacucaaccucacagagguggaugguaaaccauucauggcauuugauuccccugcaccugugggguucccugauuuuggaaaaugugauuggcacaugagaaucagcaaaaccccaaacaacacaagcucaggugaccccaugcgcagugucagcgugcaaaccaaugugcaggguuuugugccacaccugggaaguauacaguuugaugaaguguucaaccaccccacaggugacuacauuggcaccauugaauggauuucccagccaucuacacccccuggaacagauauuaaucugugggagauccccgauuauggaucaucccuuucccaagcagcuaaucuggcccccccaguauuccccccuggauuuggugaggcucuuguguacuuuguuucugcuuuuccgggccccaauaaccgcucagccccgaaugauguaccuugucuucucccucaagaguacauaacccacuuugucagugaacaagccccaacgaugggugacgcagcuuugcugcauuaugucgacccugauaccaacagaaaccuuggggaguucaagcuauacccuggagguuaccucaccuguguaccaaacgggguaggugccgggccucaacagcuuccucuuaauggugucuuucucuuugucucuugggugucucguuuuuaucagcucaagccugugggaacagccaguacggcaagauaa

SEQ ID NO: 8201 - RNA, 1617 nt, Artificial Sequence
  VP1__Norovirus_and/or_Norovirus-like__KX396056
augaugauggcgucuaaggacgccccaacaaacauggauggcaccaguggugccggucagcugguuccagaggccaguacagcugaaccuauaucaauggaaccuguggcuggugcugcuacggcagcagcaaccgcaggucaaguuaauaugauugaccccuggauuaugaguaauuauguucaagcuccucaaggagaguucacaauuuccccuaacaauacccccggagacauauuguuugauuuacaauuaggcccccauuuaaauccauuccuaucacaccuagcccaaauguauaaugguuggguuggcaauaugaaaguuaggguguugcucgcugguaacgccuuuacagcgggcaaaauaauaaucaguuguguccccccagguuuugcagcccagaaugucucaauagcccaagcuacuauguucccacacguuauugcagaugugcgggugcuugaaccaauugaagucccauuagaggacgucaggaaugugcuuuuccauaauaaugauucuaccccaacuaugaggcugauuugcaugcuuuacaccccucuucgugcuaguggcaguuccucugguacagauccauuuguuauagcuggucggguccucaccugucccaguccugacuuuaacuucuuguuccuugugcccccuaauguugaacagaaaacuaaaccauuuagugugcccaaucuuccucucaauguucucucaaauucuagaguccccuccuuaauaagguccaugauggucucucaagaucauggacagaugguacaguuccaaaaugguagggucacauuggauggacagcuccaaggcaccacccccacuucagcuagucagcucuguaagauucgagggacgguuuaucacgcaacugguggucaagggcuuaauuuaacugagauugauggcacccccuaccacgcacuugagagcccugccccaauuggcuuccccgauuuaggugagugugauuggcacauuaaugcaucuccugccaaugcuuuuacagaugguagcauuauacauagaauugauguggcccaggauuccacuuuugccccccauuuagguacuauccauuacaccaaugcuaauuaugaugcaaauauuagccugauuuguucacuugaguggcuuucccccccaagugguggugccccaaagguaaacccaugggccaucccucgguaugguucuacuuuaaccgaggcugcccagcuggcuccaccaauauaucccccugguuuuggugaggcaauuguuuucuucauguccgauuuucccauagccaaugguucagauggccuaagugucccuugcaccauaccacaagaguuugugacccauuuuguuaaugagcaagcuccaacccguggggaggcugcccuucuucauuauguugacccugacacacaccguaaucuaggugaguuuaaauuauacccugaaggauucaugaccuguguaccaaauucuaguggcaguggcccccaaacacuacccaucaauggggucuuuaccuuuaucucuuggguuucccguuuuuaccaacuaaagccugugggaacgaccggaccgguucguaggcucuaa

SEQ ID NO: 8202 - RNA, 1617 nt, Artificial Sequence
  VP1__Norovirus_and/or_Norovirus-like__AB187514
augaugauggcgucuaaggacgccccaacaaacauggauggcaccaguggugcuggucagcugguuccagaggcaaguacagcugaaccuauaucaauggagccuguggcuggugcugcuacagcagcagcaaccgcaggucaaguuaauaugauugaccccuggauuaugaguaauuauguucaagccccucaaggagaguucacaauuuccccuaacaacacucccggagauauauuguuugauuuacaauuagggccccauuugaacccauuccuaucacaccuggcccagauguacaauggauggguugguaauaugaaaguuagggugcugcucgcugguaaugccuucacagcggguaaaauaauaauuaguuguguucccccugguuuugcagcccaaaaugucucaauagcccaagcaacaauguuuccccacguuauugcagaugugagagugcuugaaccaauugaaguuccauuagaggaugugaggaaugugcucuuccacaauaaugacuccacuccaacuaugagauugauuuguauguuguauaccccucuccgugcuaguggcagcuccucuggcacugauccauuugucauagcuggacggguccucaccugucccaguccugacuuuaacuuuuuguuucuugugccccccaauguugagcagaaaacuaaaccauuuaguguaccuaaucucccccucaauguucucucaaauucuaggguucccucuuugauaaagucuaugauggucucccaagaccaugggcagauggugcacuuccagauugggagggucacauuagauggacagcuccaagguaccacucccacuucagcuagucagcucugcaaaauucgagggacgguuuaccaugcaacugguggccaagggcuuaauuugacugagauugaugggacucccuaccaugcauuugagagccccgccccaauugguuuccccgauuugggugagugugauuggcauauuaacgcaucuccugcuaaugcuuucacagaugguaguaucauacacagaauugauguggcccaggauuccacuuuugcuccccaucuaggcacuauccacuauaccaacgcuaacuaugaugccaauguuagccuaauuuguucacuugaauggcucucccccccaagcgggggugcuccaaagguuaacccaugggcuauuccucgauacgguucaacccugacugaggcugcccaguuggccccaccaauauacccucccggauuuggcgaggcaauugucuucuuuaugucugauuuccccauagcuaaugguucagaugguuugagugucccuugcacuauaccacaagaguuugugacccauuuuguuaaugaacaagcacccacucguggugaggcugcacuguugcacuauguugacccugacacacaucgcaauuugggcgaauucaaauuauacccugaagguuuuaugacuuguguccccaacuccagugguaguggaccccagacacugccuaucaaugggguuuucacuuucauuuccuggguuucucgcuucuaucaauuaaagccugugggaacgaccgguccgguccguaggcuauaa

SEQ ID NO: 8203 - RNA, 1617 nt, Artificial Sequence
  VP1__Norovirus_and/or_Norovirus-like__L07418
augaugauggcgucuaaggacgccccucaaagcgcugauggcgcaagcggcgcaggucaacuggugccggagguuaauacagcugaccccuuacccauggaacccguggccgggccaacaacagccguagccacugcugggcaaguuaauaugauugaucccuggauuguuaauaauuuuguccagucaccacaaggugaguucacaauuuccccuaauaauacccccggugauauuuuguuugauuuacaauuagguccacaucuaaacccuuucuugucacauuugucccaaauguauaauggcuggguuggaaauaugagaguuaggauucuucuugcugggaaugcuuucucagcuggaaagauuauaguuuguuguguccccccuggcuucacgucuuccucucucaccauagcucaggcuacauuguuuccccaugugauugcugaugugagaacccuugaaccaauagaaaugccucucgaggauguacgcaauguccucuaucacaccaaugauaaucaaccaacaaugcgguugguguguaugcucuacacgccgcuccguacuggugggggaucugguaauucugauucuuucguaguugcugguagggugcucacggcuccuaguagcgacuucaguuucuuguuccuugucccaccuacuauagaacagaagacucgggcuuuuacugugccuaauauccccuugcaaaccuuguccaauucuagauuuccuucccucauccaggggaugauccugucuccugacgcaucucaagugguccaguuucaaaauggacgaugccuuauagauggccaacuccuaggcaccacacccgcuacaucaggacagcuguucagaguaagaggaaagauaaaucagggagcccgcacgcuuaaccucacagagguggauggcaaaccauucauggcauuugauuccccugcaccugugggguuccccgauuuuggaaaaugugauuggcauaugagaaucagcaaaaccccaaauaacacaggcucaggugaucccaugcgcagugucagcgugcagaccaacgugcaggguuuuguaccacaccugggaagcauacaguuugaugaaguguucaaccaccccacaggugacuacauuggcaccauugaauggauuucccagccaucuacaccuccuggaacagauauuaaucugugggagauucccgauuauggaucaucccuuucccaagcagcuaaucuggcccccccaguauuccccccuggauuuggugaggcucuuguguacuuuguuucugcuuuuccaggccccaacaaccgcucagccccgaaugauguaccuugucuucuuccucaagaguacauaacccacuucgucagugaacaagccccaacaaugggugacgcagcuuugcugcauuaugucgacccugauaccaacaggaaccuuggggaguucaaacuauacccuggagguuaccucaccuguguaccaaacggggugggugccgggccucaacagcuuccucuuaaugguguuuuucucuuugucucuuggguaucucgcuuuuaucagcucaagccugugggaacagccaguacggcaagauaa

SEQ ID NO: 8204 - RNA, 1617 nt, Artificial Sequence
  VP1__Norovirus_and/or_Norovirus-like__FJ515294
augaugauggcgucuaaggacgccccucaaagcgcugauggcgcaagcggcgcaggucaacuggugccggagguuaauacagcugaccccuuacccauggaacccguggcugggccaacaacagccguagccacugcugggcaaguuaauaugauugaucccuggauuguuaauaauuuuguccagucaccgcaaggugaguuuacaauuuccccuaauaauacccccggugauauuuuguuugaucuacaauuagguccacauuuaaacccuuucuugucacauuugucccaaauguauaauggcuggguuggaaacaugagaguuaggauucuccuugcugggaaugcauucucagccggaaagauuauagucuguuguguccccccuggcuucacaucuuccucucucaccauagcucaggcuacauuguuuccccaugugauugcugaugugagaacccuugaaccaauagaaaugccccucgaggacgugcgcaauguccucuaucacaccaaugauaaucaaccaacaaugcggcugguguguaugcuguacacgccgcuccgcacugguggggggucugguaauucugauucuuuuguaguugcuggcagggugcucacggccccuaguagcgacuucaguuucuuguuccuugucccgccuaccauagaacagaagacucgggcuuuuacugugcccaauauccccuugcaaaccuuauccaauucuagguuuccuucccucauccaggggaugauucuguccccugacgcaucucaagugguccaauuccaaaauggacguugucuuauagauggucaacuccuaggcacuacacccgccacaucaggacagcuguucagagugagaggaaagauaaaucagggagcccgcacacucaaucucacagagguggauggcaagccauucauggcauuugauuccccugcaccugugggguuccccgauuuuggaaaaugugauuggcacaugagaaucagcaaaaccccaaauaacacaagcucaggugacccuaugcgcagugucgacgugcaaaccgaugugcaggguuuugugccacaccugggaagcauacaguuugaugaaguguucaaccaucccacaggugacuacauuggcaccauugaauggauuucccagccaucuacacccccuggaacagauauuaauuuaugggagauccccgauuauggaucaucccucucccaagcagcuaaucuggcccccccaguauuccccccuggauuuggugaggcucuuguguacuuuguuucugcuuuuccaggccccaacaaccgcucagccccgaaugaugugccuugucuccucccucaagaguacguaacccacuuugucagugaacaagccccaacgaugggugacgcagcuuugcugcauuaugucgacccugauaccaacagaaaccuuggggaguucaaguuauacccuggagguuaccucaccuguguaccaaacggggugggugccgggccucaacagcuuccccuuaauggugucuuucucuuugucucuugggugucucguuuuuaucagcucaagccugugggaacagccaguacggcaagauaa

SEQ ID NO: 8205 - RNA, 1617 nt, Artificial Sequence
  VP1__Norovirus_and/or_Norovirus-like__KJ790198
augaggauggcgucugaugacgccaagucggcccccuccgaccuggagggggccgggcuugucccggccacugcugccccacucccaguugcaccggucgccggcgcgcaggccgcugagcccuucgccggccaaaucaaugugauugaccccuggauuuauacuaauuuuguucaagcacccaccggugaguucacaguuucaccacgcaacacucccggugagguccuagucaaccuugaaauagguccaaaccucaacccauaccuacagcacuuggcacagauguacaacgguuaugcgggugguguggagguacaggugauccuggcggguaacgcguucacggcuggcaagcuacugugcgcgcuaguccccccuggguucccuacgagcuccaucaccccagcucagcugaccaugcucccacacacaaucauugaugugagaacgaccgauccuguggucgugcccaugccagaugugcgccgcacccucuggcacgaagugcgcuccaccacugagccgcuuaugcgacucgugaucauguuguacacaccaaugcgagcaaacucagguucugaugaggccuuuguggucucaggccguguucuauccaggccagcaccagacuucaacuucuucuaccucgugccaccacgcguugaggacacgguugagcccuuuucgcucccugaccuccgcguagaugagaugucauccucccgguggcagaaucccguugucaugcugcaggccgaccccaaccagaacaucgcggcccauuggcaaaauggcaggugcaccauuaacggggagcuacuuggcacgaccccccgaaaccagagcuggcugcuccggaugcgcggaagcguacuggcugcgccagguggccagaaggccgugacggugaacgucgaccucacggagcccgacgggcaggcuuucucugugcuuucuggcaauccuggcccugagggagugcccgacuuccaagccaucuacaauguucgcaugucaacagcgagcaccacagcugggcacaccguagccacgaauggcuauauugagcagucaggauacacccccgccuugggcacccuagucauccaaggcguugaucucagucaaguccccgcccuggguucugaggucacgaugcaaguuguguccaucgaccugaaccauaacauggaccccacuagacuaccagacuacaauggcgcuggguucgacgguucgguggcgcuggcgcccccacucguccccccgcucccgggugagguguuguugagguucaccacgcugccaaucacgacgagucgugguucuucagugucggccacccucgacugugcucugcccgcggaguggaucaccugguuccugguccacaacuucgugccccaaggcgacgcggcgcuccugcguuaccgcaacaggggcacaggccaaauucuuuucgagugcaaauuguacaaggaaggauuccuggcaguugccggugucagcacgaggaccgucuuccccacgagugggguuuucgaguucgugagcuggguccccgucuucuaccaguugaccccugugggaagcucuggggccaggaagcgcuaa

SEQ ID NO: 8206 - RNA, 1617 nt, Artificial Sequence
  VP1__Norovirus_and/or_Norovirus-like__KF306212
augaugauggcgucuaaggacgccccucaaagcgcugauggcgcaagcggcgcaggucaacuggugccggagguuaauacagcugaccccuuacccauggaaccuguggcugggccaacaacagccguagccacugcugggcaaguuaauaugauugaucccuggauuguuaauaauuuuguccagucaccucaaggugaguucacaaucucuccuaacaauacccccggugauauuuuguuugauuuacaauuagguccacaucuaaacccuuucuugucacauuugucccaaauguauaauggcuggguugggaacaugagagucagaauucuccuugcugggaaugcauucucagcuggaaagauuauaguuuguuuuguccccccuggcuuuacaucuucuucucucaccauagcucaggcuacauuguuuccccauguaauugcugaugugagaacccuugagccaauagaaaugccccucgaggauguacgcaauguccucuaucacaccaaugauaaucaaccaacaaugcggcugguguguaugcuauacacgccgcuccgcacugguggggggucugguaguucugauuccuuuguaguugcuggcaggguucucacagccccuaguagcgacuucaguuucuuguuccuugucccgccuaccauagagcagaagacucgggcuuucacugugccuaauauccccuugcaaaccuuguccaauucuagguuuccuucccucauccaggggaugauucugucccccgaugcaucucaagugguccaauuccaaaaugggcguugccuuauagauggucaacucuuaggcacuacacccgcuacaucaggacagcuguucagaguaagaggaaagauaaaucagggagcccgcacacuuaaccucacagagguggaugguaaaccauucauggcauuugauuccccugcaccugugggguuccccgauuuuggaaaaugugauuggcacaugagaaucagcaaaaccccaaacaacacaaguucaggugaccccaugcgcagugucagcgugcaaaccaaugugcaggguuuugugccacaccugggaaguauacaauuugaugaaguguuuaaucaucccacaggugacuacauuggcaccauugaauggauuucccagccaucuacacccccugggacagauauuaaucugugggagauccccgauuauggaucaucccuuucccaagcagcuaaucuggcccccccaguauuccccccuggauuuggugaggcccuuguauacuuuguuucugcuuucccgggccccaauaaccgcucagccccgaaugauguacccugucuucucccucaagaguacauaacccacuuugucagugaacaagccccaacgaugggugacgcagcuuuacugcauuaugucgacccugauaccaacaggaaccuuggggaguucaagcuauacccuggagguuaccucaccuguguaccaaacgggguaggugccgggccucaacagcucccucucaaugguguuuuucucuuuguuucuugggugucucguuuuuaccagcuuaagccugugggaacagccaguacggcaagauaa

SEQ ID NO: 8207 - RNA, 1617 nt, Artificial Sequence
  VP1__Norovirus_and/or_Norovirus-like__KM461694
augaagauggcgucgaaugacgccgcuccaucaaaugauggugcugccaaccucguaccagaggccaauaaugagguuauggcacuugaaccgguggugggagcuucaaucgcagcuccuguugucggucagcagaauauaauugaccccuggauuagagaaaauuuuguucaagcaccacagggcgaguuuacuguuucaccaaggaacucgcccggugagaugcuuuuaaaucuugaauugggcccagaacuuaaccccuauuugagucauuugucccgcauguacaauggguaugcugguggcaugcagguucaggugguccuagcugggaaugcguucacagcugggaagaucaucuuugccgcugugccaccacacuucccuguggauaauauuagugcagcccagauaacuauguguccccaugugauuguugaugugagacagcuugaaccagugcuucuaccccuccccgauauaaggaacagguucuuccauuacaaccaggaagacaccccccggaugaggcuuguggccaugcucuacacaccucuaagggcuaauuccggagaggauguguucacuguguccuguaggguucugacucgccccgcuccagauuuugaauuuacauucuuaguuccaccaacuguugaaucaaaaacaaaacccuuuacucuaccuauccuaacccuuggugagcugucuaauucccguuuuccugcugccauagauaugcuuuacacugaucccaaugaaucaauaguuguucagccccaaaaugguagauguacccuugacggcacgcugcaaggcacaacacaauuggucccaacacagauuugugccuuuagagguacucugaucagucagaaugcgagagcggccgauuuaacagauuccccccagagagcccguaaucacccguugcacguccaggucaagaaccuagauggcacacaguaugacccaacagaugacaucccugcaguccugggggcuauugacuucaaagguacaguguucggaguggcaagucagagggacgucucuggaacacaagaacagggccauuaugccacccgggcucaugaagcacacauugacacaacugauccaaaguaugcaccuaaauuaggcacaauucucaucaaaucugaaucuacugauuucaccacaaaucagcccauuagguucacuccagugggcaugggcgacaacaauuggagacagugggaauugccugacuauucugguaguuugacucuaaauaugaaccuugccccugcuguuuccccaucuuucccuggugaacgaauccuuuucuuuaggucuauaguaccaucagcuggaggcuacgggucuggcuauauagacugucucauaccccaggaaugggugcaacauuucuaccaggaggcagcaccuucacaauccgcuguugcacugguuagguaugucaaccccgacacugggcguaacaucuuugaggccaaguugcacagagaaggguuccucaccguggcuaauucuggaaacaauccuauugugguucccccuaaugguuauuuuagauuugaggcuuggguuaaucaauucuauacacucgccuaa

SEQ ID NO: 8208 - RNA, 1614 nt, Artificial Sequence
  VP1__Norovirus_and/or_Norovirus-like__AB039780
augaagauggcgucgaaugacgcagcuccaucgaaugauggcgcggcuggccucguaccagagaucaaccaugaggucauggccauagaaccuguugcaggggccucuuuagcagccccugucguaggacaacucaauauaauugaucccuggauuagaaauaauuuugugcaagccccugcuggagaauuuacuguuucaccuagaaaugcuccaggugaauuuuuauuagaucuagaguuaggcccugaguugaaccccuaccuugcucaccuugcacgcauguauaaugggcaugcaggugguauggaggugcagauagugcuugcugggaaugcguucacagcgggcaaaauccuguuugcaguuauaccaccuggauuccccuaugaaaauuugucaccugcacaauugaccaugugcccgcauguagugguggaugugaggcagcuugaaccaaucuugcugcccaugccagacauccgcaauaccuucuuccauuacaaucagagcaacgggccaaaacuuagguuaguagcuaugcuuuacacaccccuaagggcuaauaaugcuggugaagauguuuucacaguuucuugcaggguucugacccgcccaucaccagacuuugaauuuaauuuccuuguccccccuucuguugaaucuaagacuaaagcuuuuacacucccaauucuuaagauaucugagaugacaaauucaagguuucccauaccaguugaccagauguauacuaguaggaaugaaaauauaguuguucaaccacagaaugguagggugacacuugauggagagcuacagggcacaaccacacuacaaccgguguccauuuguggguuccgagggacacugcagaccaggcuggcagaccaaccaaauuacacauaccaaguacaccuugagaauuuggacggcucacccgucgacccgacagaugaagucccagccccuuugggaacaccagauuuccaggcccagcuguuuggaguuaucagucaaaggaguagugacaaugccaccagggcacaugaggccagggucaacaccaacgaucccaccuucgcaccucagaucgcccaggugcguuucaaaucaccauccaacgacuucuuugacaaugaacccauuaaauucacaccaguugggauuaguguugauagccaaaacagcuacaaccaauggcuccuucccagguauggugggcaccugacaaacaacacucaccuggcccccucuguguccccaauguuccccggcgagcagauucucuucuuccgcucguucaugccaggugcuaguggucacacugauggugcuauugacugccuuuugccacaagaauggguugcccauuucuaucaggaggccgcgacugcgcaaacagacguggcucugaucagauuugugaaucccgacacaggcagaguguuauuugaagggaaguuacacaagcagggcuuuauaaccaucucuaacaguggggaccacccuauuguuaugcccgcuaauggguacuucagguuugaggcauggguuaaccaguuuuauucucucgcccccgugggaacuggaagugggcgcagaaggauccaauaa

SEQ ID NO: 8209 - RNA, 1614 nt, Artificial Sequence
  VP1__Norovirus_and/or_Norovirus-like__AY038599
augaagauggcgucgaaugacgcagcuccaucgagugauggcgcagcgggcgucgucccagagaucaaucaugagguuauggcaauugaaccuguugcaggugcaucaaucgcugccccugugguaggacaacaaaauauuauugaucccuggauaagaaauaauuuuguacaagcacccgcuggagaauucacuguuuccccuaggaaugccccgggugaguucuugcucgauuuagaauugggcccugaucugaaccccuaucuggcacauuuggcaagaauguacaacggucaugcgggugguauggaagugcagauaguacuagcugggaaugcguucacagcugguaaaauccuauuugcugucauaccgccuggguuuccguaugaaaauuugugcccagcacaacucacgaugugcccucacgucguaguugaugugaggcagcuugagccugucaugcugcccaugccagauaucaggaauacauucuuucauuauaaucaagaugguggaccaaaauugagguuaauugccauguuguauaccccucucagagcuaauaauucaggugaugauguauuuacuguuuccuguagaguccuaacgagaccugccccugauuuugaauucacauuuuuagucccucccucuauugagucaaagacuaaggcauucacuaucccagugcuuaaaauuucugaaaugacaaauucaagauucccuguaccaguugaccaaauguacaccagcaggagcgaggggaucgugguccaaccucaaaacgguagggccaccauugacggagagcuacucggcaccacucucgucuccccaguuucugugugcaauuucaagggaaaccuacaagcugaagucccagggcaacaccaacucuaccaacuacaguugacuaaccuugauggcucaccuauugaccccacugaugauacaccugggccacuagguugcccagacuucacuggccuccucuacggagucgccagccagcgugguccaggugacgccacgcgggcccaugaggcaaggauugacaccggcagugacacuuuugcccccaaaauuggacaagucagguucuacucaaccucaagcgauuuugaaacaaaccaacccacacauuucaccccaauagguaucuacauugagggcaauucuucugauuuuaaucaauggcaacuccccagguaugguggucaccuagcuaacaacaaccaucuggcaccugcagucucgccucuauucccuggagagcaaauccuuuucuucagaucuuucaucccaggagcuaguggccacacaaauggggagauggauugccuccugccucaggaguuugugcagcacuucuaccaagaagcggcaacugcgcggucggagguggccuuacugagguuugucaacccugacacuggaagggcuuuguuugaauccaaacuccacaagcaagguuucaugacaauugcaaguucaggugaccauccuauuauuaugccaaccaaugguuauuucagauuugaagcuuggguuaaccaauuuuauucucucgccccugugggaacuggaagugggcgcagaaggauccaauaa

SEQ ID NO: 8210 - RNA, 1614 nt, Artificial Sequence
  VP1__Norovirus_and/or_Norovirus-like__AY054299
augaagauggcgucgaaugacgcagcuccaucgagugauggcgcagccggccucgucccagagaucaaucaugagguuauggcaauugaaccuguugcaggugcaucaaucgcugccccugugguaggacaacaaaauauuauugaucccuggauaagaaauaauuuuguacaagcacccgcuggagaauucacuguuuccccuaggaaugccccgggugaguucuugcuugauuuagaauuaggcccugaucugaaccccuaucuggcacauuuggcaagaauguacaacggucaugcgggugguauggaagugcagauaguacuagcugggaaugcguucacagcugguaaaauccuauuugccgucauaccgccuggguuuccguaugaaaauuuguccccagcacaacucacgaugugcccccacgucguaguugaugugaggcagcuugagccugucaugcugcccaugccagacaucaggaauacauucuuucauuauaaucaagaugguggaccaagauugagguuaauugccaugcuguauacuccucuuagagccaauaauucaggugaugauguguuuacuguuuccuguagaguccuaacaagaccugccccugauuuugaauucacauuucuagucccucccucuauugagucaaagacuaaggcauucacuaucccagugcuuaaaauuucugaaaugacuaauucaagauucccuguaccaguugaccaaauguacaccagcaggagcgaggggaucgugguccaaccucaaaacgguagggccaccauugacggagagcuacucggcaccacucucgucuccccaguuucugugugcaacuucaagggaaaccuacaagcugaagucccaggggaacaccaacucuaccaauuacaguugaccaaccuugaugguucaccuauugaucccacugaugauacaccugggccacuagguugcccagacuucacuggccuccucuacggggucgccagccagcgugguccaggugacgccacgcgggcccaugaggcaaggauugacaccggcagugacacuuaugcccccaaaauuggacaagucagguucuacucaaccucaagcaauuuugaaagaaaccaacccacacauuuuaccccaauagguaucuacauugagggcaauucuuccgauuuuaaccaauggcaacuccccagguaugguggucaccuagccaauaacaaccacuuggcaccugcaguuucgccucuauucccuggagagcaaauccuuuucuucagaucuuucaucccaggagccaguggccacacaaauggggagauggauugccuccugccucaggaguuugugcagcacuucuaccaagaagcggcaacugcgcagucggagguggccuuacugagguuugucaacccugacacuggaaggguuuuguuugaauccaaacuccacaagcaaggguucaugacaauugcaaguucaggugaccauccuaucauuaugccaaccaaugguuauuucagauuugaagcuuggguuaaccaauuuuauucucuugccccugugggaacuggaagugggcgcagaaggauccaauaa

SEQ ID NO: 8211 - RNA, 1614 nt, Artificial Sequence
  VP1__Norovirus_and/or_Norovirus-like__AF195848
augaagauggcgucgaaugacgcagcuccaucgaaugauggcgcggcuggccucguaccagagaucaaccaugaggucauggccauagaaccuguugcaggggccucuuuagcagccccugucguaggacaacuuaauauaauugaucccuggauuagaaauaauuuuguacaagccccugcuggagaauuuacuguuucaccuagaaaugcuccgggugaauuuuuguuagauuuagagcuaggcccugaauuaaaccccuaucuugcucaccuugcacgcauguauaaugggcaugcuggugguauggaggugcagauagugcuugcugggaaugcguucacagcgggcaaaauccuguuugcaguuauaccaccuggauuccccuaugaaaacuugucaccugcacaacugaccauguguccgcauguagugguggaugugaggcagcuugaaccaaucuuguugcccaugccagacauccgcaacaccuucuuccauuacaaucagaguaacgggccaaagcguagauuaguagccaugcuuuauacaccccuaagggcuaauaaugcuggugaugauguuuuuacaguuucuugcaggguucugacccgcccgucaccagacuuugaauuuaauuuccuuguucccccuucuguugaaucuaagacuaaagcauuuacacucccaguccuuaagauaucugagaugacaaauucaagauuccccauaccaguugaucagauguacacuaguaggaaugaaaacauaguuguucaaccacagaaugguagggugacacuugauggggagcugcagggcacaaccacacuccagccaguguccauuuguggauuccgagggacacugcagaccagacuggcagaccaaccaaauuacacauaucaagugcaucuugagaaucuggacggcucacccgucgacccgacagaugaggugccagcccccuugggaacaccagauuuccaggcccaguuguucggaguuaucagucaaaggaguagugacaaugccaccagagcacaugaggcuagggucaacaccaacgaccccacuuuugcaccucagaucgcucaggugcguuuuaaaucacccuccacugacuucucugacaaugaacccauuaaauucacaccgguuggaauuaguguugauagccaaaacaguuauaaccaauggcuccuccccagguaugguggacaccugacaaacaacacucaccuggcccccucuguguccccgauguuccccggcgagcagauucucuucuuccgcucguucaugccaggugccggugguuucacugauggugccauugacugccuucugccacaagaauggguugcccacuucuaucaggaggccgcgacugcacaaacagacguggcucuaaucagauuuguuaaccccgacacaggcaggguguuguuugaagggaagcuacauaagcagggcuucauaaccaucuccaacaguggggaccacccuauuguuaugcccgcuaauggauacuucagguuugaggcaugggucaaacaauuuuacucucucgcccccgugggaacuggaagugggcgcagaaggguccaauaa

SEQ ID NO: 8212 - RNA, 1614 nt, Artificial Sequence
  VP1__Norovirus_and/or_Norovirus-like__AB303927
augaagauggcgucgaaugacgccaacccaucugauggguccacagccaaccucgucccagaggucaacaaugaggucauggcuuuggagcccguuguuggugccgcuauugcggcaccuguagcgggccaacaaaauguaauugaccccuggauuagaaguaauuuuguacaagccccugguggagaguuuacaguauccccuagaaacgcuccgggugagauacuauggagcgcgcccuugggcccugaucuaaaccccuaccuuucccauuuggccagaauguacaaugguuaugcaggugguuuugaagugcagguaauccucgcggggaacgcguucaccgccgggaaaaucauauuugcagcagucccaccaaauuuuccaacugaaggcuugagccccagccaggucacuauguucccccauauaauaguagauguuaggcaauuggaaccugugcugauccccuuaccugauguuaggaauaauuucuaucauuauaaucaaucaaaugauucuacuauuaaauugauagcaaugcuguauacaccacuuagggccaauaaugcuggggaugaugucuucacagucucuugucgaguccucacgaggccaucccccgacuuugacuucauauucuuggugccacccacaguugaaucaagaacuaaaccauucaccgucccaaucuuaacuguugaggaaauguccaauucaagauuccccguuccuuuggaaaaguuguacacgggucccagcagugcuuuuguuguccaaccacaaaauggcaggugcacgacugauggcgugcucuuaggcaccacccagcugucugcugucaacaucugcaccuucagaggggaugucacccacauugcaggcagucaugauuacacaaugaauuuggcuucucaaaauuggaacaauuaugacccaacagaggaaaucccagccccucugggaaccccagauuucgugggaaagauccaaggcgugcucacccaaaccacaagagaggauggcucgacccgcgcccacaaagcuacagugagcacugggaguguccacuuuacuccaaagcugggcaguguucaauacaccacugacacaaacaaugacuuucaaacuggccaaaacacgaaauucaccccagucggcgucauccaggacgguaguaaccaucaaaaugaaccccaacaaugggugcucccaaacuacucagguagaacuggucauaaugugcacuuagccccugccguugcccccacuuuuccgggugagcaacuucuuuucuuuagguccacuaugcccggauguagcggguaucccaauaugaaucuggauugccuacucccccaggaaugggugcagcacuucuaccaagaagcagcuccagcacaaucugauguggcucugcugagauuugugaauccagacacagguaggguucuguuugagugcaaacuccauaaaucaggcuaugucacaguggcucacacuggcccgcaugauuugguuaucccccccaaugguuauuuuagauuugauuccugggucaaucaguuuuacacacuugccccuaugggaaauggagcggggcguagacguuaa

SEQ ID NO: 8213 - RNA, 1614 nt, Artificial Sequence
  VP1__Norovirus_and/or_Norovirus-like__AY038600
augaagauggcgucgaaugacgccagcccaucugauggguccacagccaaccucgucccagaggucaacaaugagguuauggcuuuggagcccguuguuggugccgcuauugcggcaccuguggcgggccaacaaaacguaauugaccccuggauuaggaauaauuuuguacaagccccugguggagaguuuacaguauccccuagaaacgcuccaggugagauacuauggagcgcgcccuugggcccugauuugaaccccuaccuuucucauuuggccagaauguacaaugguuaugcaggugguuuugaagugcagguaauccucgcggggaacgcguucaccgccgggaaagucauauuugcagcagucccaccaaauuuuccaacugaaggcuugagccccagccagguuacuauguucccccauauaauaguagauguuaggcaauuggaaccuguguugauccccuuaccugauguuaggaauaacuucuaucauuacaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccgaucuuaacuguugaggaaauguccaacucaagauuccccauuccuuuggaaaaguuguacacgggucccagcagugcuuuuguuguccaaccacaaaauggcaggugcacgacugauggcgugcucuuaggcacuacccagcugucugcugucaauaucugcaccuucagaggggaugucacccacauugcaggcagucaugacuauauaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugagcacugggagcguccacuucacuccaaaguugggcaguguucaauacaccacugacacaaacaaugaucuucaaacuggccaaaacacgaaauucaccccagucggcgucauccaggaugguaauaaccaccaaaaugaaccccagcaauggguacucccaaauuacucagguagaacuggucauaaugugcaccuagcuccugccguugcccccacuuucccaggcgagcaacuucucuucuuuagguccacuaugcccggguguagcggguaucccaacaugaaucuggauugccuacucccccaggaaugggugcagcacuucuaccaagaagcagcuccagcacaaucugauguggcucugcugagauuugugaauccagacacagguaggguucuguuugagugcaagcuccauaaaucaggcuaugucacaguggcucacacuggcccgcaugauuugguuaucccccccaaugguuauuuuagauuugauuccugggucaaccaguucuacacacuugcccccaugggaaauggagcggggcgcagacguuaa

SEQ ID NO: 8214 - RNA, 1614 nt, Artificial Sequence
  VP1__Norovirus_and/or_Norovirus-like__AF080554
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuugugcaagccccugguggagaguuuacaguauccccuagaaacgcuccgggugagauacuauggagcgcgcccuuaggcccugauuugaaccccuaccuuucucauuuggccagaauguacaaugguuaugcaggugguuuugaagugcaaguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaacaauuucuaucacuacaaucaaucaaaugauuccaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggaugucacccacauugcgggcagucaugauuauacaaugaauuuggcuucucaaaauuggaacaauuaugacccaacagaagaaaucccagccccucugggaacuccagauuucgugggaaagauccaaggcgugcucacccaaaccacaaaagaggauggcucgacccgcgcccacaaagcuacagugagcacugggaguguccacuuuacuccaaagcugggcaguguucaauacaccacugacacaaacaaugauuuucaaacuggccaaaacacgaaauucaccccagucggcgucauccaggacgguaauaaccaucaaaaugaaccccaacaauggguacucccaaauuacucagguagaacuggucauaaugugcaccuagcuccugccguugcccccacuuuuccgggugagcaacuucuuuucuuuagguccacuaugcccggauguagcggguaccccaacaugaaucuggacugccuacucccccaggaaugggugcagcacuucuaccaagaagcagcuccagcacaaucugauguggcucugcugagauuugugaauccagacacagguaggguucuguuugaguguaagcuccauaaaucaggcuaugucacaguggcucacacuggcccgcaugauuugguuaucccccccaaugguuacuuuagauuugauuccugggucaaccaguucuacacacuugcccccaugggaaauggagcggggcguagacguuaa

SEQ ID NO: 8215 - RNA, 1614 nt, Artificial Sequence
  VP1__Norovirus_and/or_Norovirus-like__AB294778
augaagauggcgucgaaugacgccaacccaucugauggguccacagccaaccucgucccagaggucaacaaugaggucauggcuuuggagcccguuguuggugccgcuauugcggcaccuguagcgggccaacaaaauguaauugaccccuggauuagaaauaauuuuguacaagccccugguggagaguuuacaguguccccuagaaacgcuccgggugagauacuauggagcgcgcccuugggcccugaucugaaccccuaccuuucccauuuggccagaauguacaaugguuaugcaggugguuuugaagugcagguaauccuugcggggaacgcguucaccgccgggaaaaucauauuugcagcagucccaccaaauuuuccaacugaaggcuugagcccuagucaggucacuauguucccccauauaauaguagauguuaggcaauuggaaccugugcugauccccuuaccugaugucaggaauaauuucuaccacuacaaucaaucaaaugauucuaccauuaaauugauagcaaugcuguauacaccacuuagggccaauaaugcuggggaugaugucuucacagucucuugucgaguccucacgaggccaucccccgacuucgauuucauauucuuggugccacccacaguugaaucaagaacuaaaccauucaccgucccaaucuuaacuguugaggaaauguccaauucaagauuccccguuccuuuggaaaaguuguacacgggucccagcagugcuuuuguuguccaaccacaaaauggcaggugcacgacugacggcgugcucuuaggcaccacccagcugucugcugucaacaucugcaccuucagaggggaugucacccacauugcaggcagucaugauuacacaaugaauuuggcuucucaaaauuggaacaauuaugacccaacagaagaaaucccagcuccucugggaaccccagauuucgugggaaagauccaaggcgugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaauucaccccagucggcgucauccaggacgguaguaaccaucaaaaugaaccccaacaaugggugcucccaaacuauucagguagaacuggucauaaugugcacuuagccccugccguugcccccacuuuuccgggugagcaacuucuuuucuuuagguccacuaugcccggauguagcggguaucccaauaugaaucuggauugccuacucccccaggaaugggugcagcacuucuaccaagaagcagcuccagcacaauccgauguggcucuguugagauuugugaauccagacacagguaggguucuguuugagugcaaacuccauaaaucaggcuaugucacaguggcucacacuggcccgcaugauuugguuaucccccccaaugguuauuuuagauuugauucuuggguuaaucaguuuuacacacuugccccuaugggaaauggagcggggcguagacguuaa

SEQ ID NO: 8216 - RNA, 1614 nt, Artificial Sequence
  VP1__Norovirus_and/or_Norovirus-like__AB303922
augaagauggcgucgaaugacgccaccccaucugauggguccacagccaaccucgucccagaggucaacaaugagguuauggcuuuggagcccguuguuggugccgcuauugcggcaccuguagcgggccaacaaaauguaauugaccccuggauuagaaguaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagaugucaggcaauuggaaccuguguugauccccuuaccugauguuaggaacaauuucuaucauuacaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaaaauccaaggcgugcucacccaaaccacaagaggggauggcucgacccgcgcccacaaagcuacagugagcacugggaguguccacuuuacuccaaagcugggcaguguucaauacaccacugacacaaacaaugauuuucaaacuggccaaaacacgaaauucaccccagucggcgucauccaggacggugauaaccaucaaaaugaaccccaacaaugggugcucccaaauuacucagguagaacuggucauaaugugcacuuagccccugccguugcccccacuuucccgggugagcaacuucuuuucuuuagguccacuaugcccggauguagcggguaucccaacaugaaucuggauugccuacucccccaggaaugggugcagcacuucuaccaagaagcagcuccagcacaaucugauguggcucugcugagauuugugaauccagacacagguaggguucuguuugagugcaagcuccauaagucaggcuaugucacaguggcucacacuggcccgcaugauuugguuaucccccccaaugguuacuuuagauuugauuccugggucaaccaguucuacacacuugcccccaugggaaauggagcggggcguagacgcuaa

SEQ ID NO: 8217 - RNA, 1614 nt, Artificial Sequence
  VP1__Norovirus_and/or_Norovirus-like__AY532128
augaagauggcgucgaaugacgccaacccaucugauggguccacagccaaccucgucccagaggucaacaaugagguuauggcuuuggagcccguuguuggugccgcuauugcggcaccuguagcgggccaacaaaauauaauugaccccuggauuagaaauaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaacaauuucuaucauuacaaucaaucaaaugauucuaccauuaaauugauagcaaugcuguauacaccacuuagggcuaauaaugcuggggaugaugucuucacggucucuugucgaguccucacgaggccaucccccgauuuugauuuuauauucuuggugccccccacagucgaaucaagaacuaaaccauucaccgucccaaucuuaacuguugaggaaauguccaauucaagauuccccauuccuuuggaaaaguuguacacgggucccaguagugcauuuguuguccaaccacaaaauggcaggugcacgacugacggugugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaagguauacucacccaaaccacaagagaggauggcucgacccgcgcccacaaagcuacaguaagcacugggaguguccacuuuacuccaaagcugggcaguguucaauacaccacugacacaaacaaugauuuucaaacuggccaaaacacgaaguucaccccagucggcgucauccaggacgguaauaaccaucaaaaugaaccccaacaauggguacucccaaguuacucaggcagaacuggccauaaugugcaccuagcuccugccguugcccccacuuuuccgggugagcaacuucuuuucuuuagguccacuaugcccggauguagcggguaucccaacaugaaucuggauugccuacucccccaggaaugggugcagcacuucuaccaagaagcagcuccagcacaaucugauguggcucugcugagauucgugaauccagauacagguaggguucuguuugagugcaagcuccauaaaucaggcuaugucacaguggcucacacuggcccgcaugauuugguuaucccccccaaugguuacuuuagauuugauuccugggucaaccaguucuacacacuugcccccaugggaaauggagcggggcguagacguuaa

SEQ ID NO: 8218 - RNA, 1614 nt, Artificial Sequence
  VP1__Norovirus_and/or_Norovirus-like__AY532113
augaagauggcgucgaaugacgccaacccaucugauggguccacagccaaccucgucccagaggucaacaaugagguuauggcuuuggagcccguuguuggugccgcuauugcggcaccuguagcgggccaacaaaauauaauugaccccuggauuagaaauaauuuuguacaagccccugguggagaguuuacaguauccccuagaaacgcuccgggugagauacuauggagcgcgcccuuggguccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaacaauuucuaucauuacaaucagucaaaugauucuaccauuaaauugauagcaaugcuguauacaccacucagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggauguuacccacauugcaggcagucaugauuauacaaugaauuuggcuucucaaaauuggaacaauuaugacccaacagaagaaaucccagccccucugggaacuccagauuuugugggaaagauccaagguaugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaguucaccccagucggcgucauccaggacgguaauaaccaucaaaaugaaccccaccaauggguacucccaaauuacucaggcagaacuggucauaaugugcaccuagcuccugccguugcccccacuuuuccgggugagcaacuucuuuucuuuagguccacuaugcccggauguagcggguaucccaacaugaaucuggauugccuacucccccaggaaugggugcagcacuucuaccaagaagcggcuccagcacaaucugauguggcccugcugagauucgugaauccagauacagguaggguucuguuugagugcaagcuccauaaaucaggcuaugucacaguggcucacacuggcccgcaugauuugguuaucccccccaaugguuacuuuagauuugauuccugggucaaccaguucuacacacuugcccccaugggaaauggagcggggcguagacguuaa

SEQ ID NO: 8219 - RNA, 1614 nt, Artificial Sequence
  VP1__Norovirus_and/or_Norovirus-like__EU078406
augaagauggcgucgagugacgccaacccaucugauggguccgcagccaaccucgucccagaggucaacaaugagguuauggcucuggagcccguuguuggugccgcuauugcggcaccuguggcgggccaacaaaacauaauugaccccuggauuagaaauaauuuuguacaagccccugguggugaguucacgguguccccuagaaacgcuccaggugagauacuguggagugcacccuugggcccugauuugaaccccuaucuuucucaucugucuagaauguauaaugguuaugcagguggcuuugaagugcaaguaauccucgcggggaacgcguucaccgccgggaagaucauauuugcagcaguuccaccaaacuuuccaacugaaggcuuaagccccagccagguuacuauguucccucauguaauuguagauguuaggcaauuggaaccuguguugauuccccuaccugauguuaggaauaauuucuaucacuauaaucaagcacaugauccuaccauuaaguugauagcaauguuguacacaccacuuagggcuaauaaugccggggaugaugucuucacagucucuugucgaguccucacgaggccaucccccgauuuugauuuuauauuccuugugccacccacaguugaaucaagaaccaaaccauuuaccgucccaauuuuaaccguugaggaaaugucuaacucaagauuccccauuccuuuggaaaaguuguacacgggucccagcagugauuuuguuguccaaccacaaaauggcagguguacgacugacggcguacuuuuaggcaccacucagcugucagcuguuaacaucuguaacuuuaagggggaugucacccauauugcgggcagccgugacuauagaaugaaucuggugucccaaaauuggaacaauuaugacccaacagaagaaaucccagccccccugggaacaccagauuuccaggggaagauccaaggccugcucacccagacaacaggagcugauggcucgacccgugcccacaaggccacagugagcacuggggccgccaacuucacuccaaagcuggguaguguucaauucaccacugacacagauaaugauuuccaaacuggccaaaacacaaaauucaccccaguuggcgucauccaagacggcagucaccaucagaaugaaccccaacaauggguacucccaaauuacucagguagaacugugcacaacgugcaccuggccccugccguugcccccacuuuuccgggugagcaacuccuuuucuucagguccacuaugcccggaugcagcggguaccccaacaugaaccuggacugucuacucccccaggaaugggugaugcacuucuaccaggaagcagccccagcacaaucugauguggcucuguugagauuuguuaauccagacacaggcaggguucuguuugaguguaagcuccauaaagcaggcuauaucacaguggcucacacuggucagcaugauuugguuaucccccccaaugguuauuucagauuugauuccugggucaaccaguucuacacacuugcccccaugggaaauggagcggggcgcaggcgcuaa

SEQ ID NO: 8220 - RNA, 1614 nt, Artificial Sequence
  VP1__Norovirus_and/or_Norovirus-like__AF472623
augaagauggcgucgaaugacgccaacccaucugauggguccacagccaaccucgucccagaggucaacaaugagguuauggcuuuggagcccguuguuggugccgcuauugcggcaccuguagcgggccaacaaaauauaauugaccccuggauuagaaauaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaacaauuucuaucauuacaaucaaucaaaugauucuaccauuaaauugauagcaaugcuguauacaccacuuagggcuaacaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggauguuacccacauugcaggcagucaugauuauacaaugaauuuggcuucucaaaauuggaacaauuaugacccaacagaagaaaucccagccccucugggaacuccagauuucgugggaaagauccaagguaugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaguucaccccagucggcgucauccaggacgguaauaaccaucaaaaugaaccccaacaauggguacucccaaauuacucaggcagaacuggucauaaugugcaccuagcuccugccguugcccccacuuuuccgggugagcaacuucuuuucuuuagguccacuaugcccggauguagcggguaucccaacaugaaucuggauugccuacucccccaggaaugggugcagcacuucuaccaagaagcagcuccagcacaaucugauguggcucugcugagauucgugaauccagauacagguaggguucuguuugagugcaagcuccauaaaucaggcuaugucacaguggcucacacuggcccgcaugauuugguuaucccccccaaugguuacuuuagauuugauuccugggucaaccaguucuacacacuugcccccaugggaaauggagcggggcguaggcguuaa

SEQ ID NO: 8221 - RNA, 1614 nt, Artificial Sequence
  VP1__Norovirus_and/or_Norovirus-like__AF427114
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguguccccuagaaacgcuccgggugagauacuauggagcgcgcccuugggcccugauuugaaccccuaccuuucccauuuggccagaauguacaaugguuaugcaggugguuuugaagugcagguaauccucgcggggaacgcguucaccgccgggaaaaucauauuugcagcagucccaccaaauuuuccaacugaaggcuugagccccagccaggucacuauguucccccauauaauaguagauguuaggcaauuggaaccuguguugauccccuuaccugauguuaggaauaauuucuaccauuacaaucaaucaaaugauucuaccauuaaauugauagcaaugcuguauacaccacuuagggccaacaaugcuggggaugaugucuucacagccucuugucgaguccucacgaggccaucccccgauuuugacuucauauucuuggugccacccacaguugaaucaagaacuaaaccauucaccgucccaaucuuaacuguugaggaaauguccaauucaagauuccccauuccuuuggagaaguuguacacgggucccagcagugcuuuuguuguccaaccacaaaauggcaggugcacgacugauggcgugcucuuaggcaccacccagcugucugcugucaacaucugcaccuucagaggggaugucacccacauugcaggcagucaugauuacacaaugaauuuggcuucucaaaauuggaacaauuacgacccaacagaagaaaucccagccccucugggaaccccagauuucgugggaaagauccaaggcgugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaauucaccccagucggcgucauccaggacgguaguaaccaucaaaaugaaccccaacaaugggugcucccaaacuacucagguagaacuggucauaaugugcaccuagccccugccguugcccccacuuuuccaggugagcaacuucuuuucuuuagauccacuaugcccggauguagcggguaucccaauaugaaucuggauugccuacucccccaggaaugggugcagcacuucuaccaagaagcagcuccagcacaaucugauguagcucugcugagauuugugaauccagacacagguaggguucuguuugagugcaagcuccauaaaucaggcuaugucacaguggcucacacuggcccgcaugauuugguuaucccccccaaugguuacuuuagauuugauucuugggucaaccaguuuuacacacuugcccccaugggaaauggagcggggcguagacgcuaa

SEQ ID NO: 8222 - RNA, 1614 nt, Artificial Sequence
  VP1__Norovirus_and/or_Norovirus-like__AY532114
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaauuuacaguauccccuagaaacgcuccgggugagauacuauggagcgcgcccuugggcccugauuugaaccccuaccuuucucauuuggccagaauguacaauggcuaugcaggugguuuugaagugcagguaauucucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaauaauuucuaccauuauaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcuccuaggcaccacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaauucaccccagucggcgucauccaggaugguaauaaccaucaaaaugaaccccaccaauggguacucccaaauuacucagguagaacuggucacaaugugcaccuagcuccugccguugcccccacuuuuccgggugagcagcuucuuuucuuuagauccacuaugcccggauguagcggguaucccaacaugaaucuggauugccuacucccccaggaaugggugcagcacuucuaccaagaagcagcuccagcacaauccgauguggcucugcugagauuugugaauccagauacagguaggguucuguuugagugcaagcuccauaaaucaggcuaugucacaguggcucacacuggcccgcaugacuugguuaucccccccaaugguuacuuuagauuugauuccugggucaaccaguucuacacacuugcccccaugggaaauggagcggggcguagacguuaa

SEQ ID NO: 8223 - RNA, 1614 nt, Artificial Sequence
  VP1__Norovirus_and/or_Norovirus-like__KF806505
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggggaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccaauucaagguuccccauucccuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuuacaggcaccuccgaauacgcaaugaauuuggcuucucaaaauuggaauaauuaugacccaacagaagaaaucccagccccucugggagccccagauuuugugggaaagauccgagguaugcucacucaaaccacaaggagggacgguucgacccgcggccacagggcuacauugagcacugggagcgcccacuucacuccaaagcugggcagcauucgguuuuccacugauacaaacaaugauuuugaagcuggccaaaacacgaaauucaccccagucggugucuuccaggaaggcgacaaccaccaaaaugaaccccaacaaugggugcucccaaauuauucaggugcaacugcccacaauguacaccuugccccugccguggcccccgcuuuuccgggugagcaacugcucuucuucagguccaccaugcccggauguggcggguaucccaacaugaauuuggauugucuacucccacaggaaugggugcagcacuucuaucaagaggcagccccagcacaaucugacguggcucugcuaagauuugugaauccagauacaaguaggguuuuguuugagugcaagcuccauaaaucagguuaugucacaguggcccacacuggccagcaugauuugguuauccccccuaauggcuacuuuagauuugauuccugggucaaccaauucuacacacuugcccccaugggaaauggaacggggcguagacguuaa

SEQ ID NO: 8224 - RNA, 1614 nt, Artificial Sequence
  VP1__Norovirus_and/or_Norovirus-like__JQ478407
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguguccccuagaaacgcuccgggugagauacuauggagcgcgcccuugggcccugauuugaaccccuaccuuucucauuuagccagaauguacaaugguuaugcaggugguuuugaagugcagguaauccuugcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaauaacuucuaucauuauaaucaaucaaaugauucuaccauuaaauugauagcaaugcuguauacaccacuuagggcuaauaaugcuggggaugacgucuucacagucucuugucgaguccucacgaggccaucccccgauuuugauuucauauucuuggugccacccacaguugaaucaagaacuaaaccauucaccgucccaaucuuaacuguugaggaaauguccaacucaagauuccccauuccuuuggaaaaguuguacacgggucccagcagugcuuuuguuguccaaccacaaaauggcaggugcacgacugauggcgugcucuugggcaccacccagcugucugcugucaacaucugcaccuucagaggggauaucacucacauugcaggcagucaugacuauacaaugaaucuggcuucucaaaauuggagcaauuaugacccaacagaagaaaucccagccccucugggaacuccagacuucgugggaaagauccaaggcaugcucacccaaaccacaagagaggauggcucgacccgcgcccacaaagccacagugagcacugggaguguccacuuuacuccaaagcugggcaguguucaauacaccacugacacaaacaaugauuuucaaacuggccaaaacacaaaauucaccccagucggcgucauccaggacggugguaaccaucaaaaugaaccccaacaauggguacucccaaauuauucagguagaacuggucauaaugugcaccuagcuccugccguugcccccacuuucccgggugaacaacuucucuucuuuagguccacuaugcccgggugcagcggguaucccaacaugaaucuggauugccuacuuccccaggaaugggugcaacacuucuaucaagaagcagccccagcacaaucugauguggcccugcugagauuugugaauccagacacagguaggguuuuguuugagugcaaacuucauaaaucaggcuauguuacaguggcucacacugguccgcaugaucugguuaucccccccaaugguuacuucagauuugauuccugggucaaccaguucuacacacuugcccccaugggaaauggagcggggcguagacguuaa

SEQ ID NO: 8225 - RNA, 1614 nt, Artificial Sequence
  VP1__Norovirus_and/or_Norovirus-like__AB303923
augaagauggcgucgaaugacgccaacccaucugauggguccacagccaaccucgucccagaggucaacaaugagguuauggcuuuggagcccguuguuggugccgcuaucgcggcaccuguagcgggccaacaaaauguaauugaccccuggauuagaaauaauuuugugcaagccccugguggagaguuuacaguauccccuagaaacgcuccgggugagauccuuuggagcgcgcccuugggcccugauuugaaccccuaccuuucucauuuggccagaauguacaaugguuaugcaggugguuuugaagugcagguaauccucgcggggaaugcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaauaauuucuaucauuauaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaacucaagauuccccauuccuuuggaaaaguuguacacgggucccagcagcgcuuuuguuguccaaccacaaaauggcaggugcacaacugauggcgugcucuuaggcacuacccagcuguccgcugucaacaucugcaccuucagaggggaugucacccacauugcgggcagucaugauuauacaaugaauuuggcuucucaaaauuggaacaauuaugacccaacagaagagaucccagccccucugggaacuccagacuucgugggaaagauccaaggcaugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaauuuaccccagucggcgucauccaggacgguaauaaccaucaaaaugaaccccaacaauggguacucccaaauuauucagguagaacuggucacaaugugcaccuagcuccugccguugcccccacuuuuccgggugagcaacuucuuuucuuuagguccacuaugcccggauguagcggguaucccaacaugaaucuggauugccuacucccccaggaaugggugcagcacuucuaccaagaagcagcuccagcacaaucugauguggcucugcugagauuugugaauccagacacagguaggguuuuguuugagugcaagcuccauaaaucaggcuauguuacaguggcucacacuggcccgcaugauuugguuaucccccccaaugguuacuuuagauuugauuccugggucaaccaguucuacacacuugcccccaugggaaauggagcggggcguagacgcuaa

SEQ ID NO: 8226 - RNA, 1614 nt, Artificial Sequence
  VP1__Norovirus_and/or_Norovirus-like__AF427120
augaagauggcgucgaaugacgccaacccaucugauggguccacagccaaccucgucccagaggucaacaaugagguuauggcuuuggagcccguuguuggugccgcuauugcggcaccuguggcgggccaacaaaauguaauugaccccuggauuagaaauaauuuuguacaagccccugguggagaguucacaguauccccuagaaacgcuccgggugagauauuauggagcgcgcccuugggcccugauuuaaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccaggucacuauguuuccccauauaauaguggauguuaggcaauuggaaccuguguugauccccuuaccugauguuaggaauaacuucuaucacuauaaucaaucaaaugacuccaccauuaaauugauagcaaugcuguacacaccacuuagggcuaauaaugcuggggaugacgucuucacagucucuugucgaguccucacgaggccauccccugauuuugauuucauauucuuggugccacccacagucgaaucuaggacuaaaccauucaccgucccaaucuuaacuguugaggaaauguccaacucaagauuccccaucccuuuggaaaaguuguacacgggucccagcagugcuuuuauuguccaaccgcaaaauggcagguguacgacugauggcgugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucaacccgcgcccacaaagcuacagugagcacugggaguguccacuuuaccccaaagcuggguaguguucaauacaccacugacacaaacaaugauuuucaaacuggccaaaacacgaaauucaccccagucggcgucauccaggacggcaauaaccaucaaaaugaaccccaacaaugggugcucccaaauuacucagguagaacuggucauaaugugcaucuagcuccugccguugcccccacuuucccgggugagcaacuucuuuucuuuagguccacuaugcccggauguagcggguaucccaacaugaaucuggauugccuacucccccaggaaugggugcagcacuuuuaccaagaagcagcuccagcacaaucugauguggcucugcugagauuugugaauccagacacgggcaggguucuguuugagugcaagcuccauaaaucaggcuaugucacaguggcucacacuggcccgcacgauuugguuaucccccccaaugguuacuucagauuugauuccugggucaaccaguucuauacacuugcccccaugggaaauggagcggggcgcagacguuaa

SEQ ID NO: 8227 - RNA, 1614 nt, Artificial Sequence
  VP1__Norovirus_and/or_Norovirus-like__AY532134
augaagauggcgucgaaugacgccaacccaucugauggguccacagccaaccucgucccagaggucaacaaugagguuauggcuuuggagcccguuguuggugccgcuauugcggcaccuguagcgggccaacaaaauauaauugaccccuggauuagaaauaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaacaauuucuaucauuacaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaauuaaaccauucaccgucccgaucuuaacuguugaggaaauguccaauucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggauguuacccacauugcaggcagucaugauuauacaaugaauuuggcuucucaaaauuggaacaauuaugacccaacagaagaaaucccagccccucugggaacuccagauuucgugggaaagauccaaggugugcucacccaaaccacaagagaggauggcucgacccgcgcccacaaagcuacagugagcacugggaguguccacuuuacuccaaagcugggcaguguucaauacaccacugacacaaacaaugauuuucaaacuggucaaaacacgaaguucaccccagucggcgucauccaggacgguaauaaccaucaaaaugaaccccaacaauggguacucccaaauuacucaggcagagcuggucauaaugugcaccuagcuccugccguugcccccacuuuuccgggugagcaacuucuuuucuuuagguccacuaugcccggauguagcggguaucccaacaugaaucuggauugccuacucccccaggaaugggugcagcacuucuaccaagaagcagcuccagcacaaucugauguggcucuacugagauucgugaauccagauacagguaggguucuguuugagugcaagcuccauaaaucaggcuaugucacaguggcucacacuggcccgcaugauuugguuaucccccccaaugguuacuuuagauuugauuccugggucaaccaguucuacgcacuugcccccaugggaaauggagcggggcguagacguuaa

SEQ ID NO: 8228 - RNA, 1614 nt, Artificial Sequence
  VP1__Norovirus_and/or_Norovirus-like__AY532116
augaagauggcgucgaaugacgccaacccaucugauggguccacagccaaccucgucccagaggucaacaaugagguuauggcuuuggagcccguuguuggugccgcuauugcgacaccuguagcgggccaacaaaauguaauugaccccuggauuagaaauaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauucccuuaccugauguuaggaauaacuuuuaccauuauaaucaaucaaaugauucuaccauuaaauugauagcaaugcuguauacaccacuuagggcuaauaaugcuggggaugaugucuucacagucucuugucggguccucacgagaccaucccccgauuuugauuucauauucuuggugccacccacaguugaaucaagaacuaaaccauucaccgucccaaucuugacuguugaggaaauguccaauucaagauuccccauuccuuuggaaaaguuguacacgggucccagcagugcuuuuguuguccaaccacaaaauggcagaugcacgacugauggcgugcuccuaggcacuacccagcugucugcugucaacaucugcacuuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaguucaccccagucggcgucauccaggacgguaauaaccaucaaaaugaaccccaacaauggguacucccaaauuacucaggcaggacuggacauaaugugcaccuagcuccugccguugcccccacuuucccgggugagcaacuucuuuucuuuagguccaccaugcccggaugcagcggguaucccaacaugaaucuggauugccuacucccccaggaaugggugcagcacuucuaccaagaggcagcuccagcacaaucugauguggcucuacugagauuugugaacccagauacagguaggguucuguuugaguguaagcuccauaaaucaggcuaugucacaguggcucacacuggcccgcaugauuugguuaucccccccaaugguuacuuuagauuugauuccugggucaaccaguucuacacacucgcccccaugggaaauggagcggggcguagacguuaa

SEQ ID NO: 8229 - RNA, 1614 nt, Artificial Sequence
  VP1__Norovirus_and/or_Norovirus-like__AY532112
augaagauggcgucgaaugacgccaacccaucugauggguccacagccaaccucgucccagaggucaacaaugagguuauggcuuuggagcccguuguuggugccgcuauugcggcaccuguagcgggccaacaaaauauaauugaccccuggauuagaaauaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaacaauuucuaucauuacaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgccccaaucuuaacuguugaggaaauguccaauucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggauguuacccacauugcaggcagucaugauuauacaaugaauuuggcuucucaaaauuggaacaauuaugacccaacagaagaaaucccagccccucugggaacuccagauuucgugggaaagauccaagguaugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaguucaccccagucggcgucauccaggacgguaauaaccaucaaaaugaaccccaacaauggguacucccaaauuacucaggcagaacuggucauaaugugcaccuagcuccugccguugcccccacuuuuccgggugagcaacuucuuuucuuuagguccacuaugcccggauguagcggguaucccaacaugaaucuggauugccuacucccccaggaaugggugcagcacuucuaccaagaagcagcuccagcacaaucugauguggcucugcugagauucgugaauccagauacagguaggguucuguuugagugcaagcuccauaaaucaggcuaugucacaguggcucacacuggcccgcaugauuugguuaucccccccaaugguuacuuuagauuugauuccugggucaaccaguucuacacacuugcccccaugggaaauggagcggggcguagacguuaa

SEQ ID NO: 8230 - RNA, 1614 nt, Artificial Sequence
  VP1__Norovirus_and/or_Norovirus-like__KX514275
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuuuauauuucuggugccaccuacaguugagucaagaacuaaaccauuuucugucccaauucuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggagugccgauuucacuccaaagcugggcaaaguucaauuugaaacugauacagaagaugaucuugcaauucgccaaaacacaaaauucaccccagucgguguuauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8231 - RNA, 1614 nt, Artificial Sequence
  VP1__Norovirus_and/or_Norovirus-like__KF806510
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaggaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccaauucaagguuccccauucccuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuuacaggcaccuccgaauacgcaaugaauuuggcuucucaaaauuggaauaauuaugacccaacagaagaaaucccagccccucugggagccccagauuuugugggaaagauccgagguaugcucacucaaaccacaaggagggacgguucgacccgcggccacagggcuacauugagcacugggagcgcccacuucacuccaaagcugggcaacauucgguuuuccacugauacaaacaaugauuuugaagcuggccaaaacacgaaauucaccccagucggugucuuccaggaaggcgacaaccaccaaaaugaaccccaacaaugggugcucccaaauuauucaggugcaacugcccacaauguacaccuugccccugccguggcccccgcuuuuccgggugagcaacugcucuucuucagguccaccaugcccggauguggcggguaucccaacaugaauuuggauugucuacucccacaggaaugggugcagcacuucuaucaagaggcagccccagcacaaucugacguggcucugcuaagauuugugaauccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacguuaa

SEQ ID NO: 8232 - RNA, 1614 nt, Artificial Sequence
  VP1__Norovirus_and/or_Norovirus-like__EU078410
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguuuccccuaggaacgcuccgggugagauacuauggagcgcgcccuugggcccagauuugaaccccuaucuuucucauuuggccagaauguacaaugguuaugcaggugguuuugaagugcagacaauccucgcggggaacgcguucaccgccgggaaaaucauauuugcagcagucccaccaaauuuuccaacugaaggcuugagccccagucaaguuacuauguucccccacauaauaguagauguuaggcaauuggaaccuguguugauccccuuaccugauguuaggaauaacuucuaucauuauaaucaaucaaaugauccuaccauuaaauugauagcaaugcuguauacaccacuuagggcuaauaaugcuggggaugaugucuucacagucucuugucgaguccucacgaggccaucccccgauuuugauuuuauauuccuggugccacccacaguugaaucaagaacuaaaccauucaccgucccaaucuuaacaguugaggaaauguccaauucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggaugucacccacauugcaggcagucacgacuacacaaugaauuuggcuucucaaaauuggaacaauuaugacccaacggaagaaaucccagccccucuggggacuccagauuuugugggaaagauccaaggcaugcucacccaaaccacaagagaggauggcucgacccgcgcccacaaagcuacagugagcacugggaguguccacuuuacuccaaagcugggcaguguucaauacaccacugacacaaacaaugauuuucaagcuggccaaaacacgaaauucaccccagucggugucauccaggacgguaauaaccaccagaaugaaccccaacaauggguacucccaaacuacucagguagaacuggucauaaugugcaccuagcuccugccguugcccccacuuucccgggugagcaacuucuuuucuuuagguccacuaugcccggauguagcggguaccccaacaugaaucuggauugccuacucccccaggagugggugcagcacuuuuaccaagaagcagcuccagcacagucugauguggcuuugcugagauuugugaauccagacacagguaggguucuguuugagugcaaacuccauaaaucaggcuaugucacaguggcucacacuggcccgcaugauuugguuaucccccccaaugguuacuuuagauuugauuccugggucaaccaauucuacacgcuugcccccaugggaaauggaacggggcguagacguuaa

SEQ ID NO: 8233 - RNA, 1614 nt, Artificial Sequence
  VP1__Norovirus_and/or_Norovirus-like__AF427123
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauucccuuaccugaugucaggaauaauuucuaucauuauaaucaaucaaaugauucuaccauuaaauugauagcaaugcuguacacaccacuuagggcuaauaaugcuggggaugaugucuucacagucucuugucgaguccucacgaggccaucccccgauuuugauuucauauucuuggugccaccaacaguugaaucaagaacuaaaccauucaccgucccaaucuuaacuguugaggaaauguccaauucaagguuccccauuccuuuggaaaaguuguacacgggccccagcagugcuuuuguuguccaaccacagaacggcaggugcacgaccgauggcgugcuccuaggcaccacccaguugucugcugucaacaucugcaccuucagaggggaugucacccacauugcaggcagucaugauuacacaaugaauuuggcuucucaaaauuggaacaauuaugacccaacagaagaaaucccagccccucugggaaccccagauuucgugggaaagauccaaggugugcucacccaaaccacaagagaggacggcucgacccgcgcccacaaagcuacagugagcacugggaguguccacuuuacuccaaagcugggcaguguucaauacaccacugauacaaacaauaauuuucaaacuggccaaaacacgaaauucaccccagucggcgucauccaggacgguaauaaccaucaaaaugaaccccaacaauggguacucccaaauuauucaggcagaacuggucacaaugugcaccuagcuccugccguugcccccacuuuuccgggugagcaacuccuuuucuuuagguccacuaugcccggauguagcggguaucccaacaugaauuuggauugccuacucccccaggaaugggugcagcacuucuaccaagaagcggcuccagcacaaucugauguggcucugcugagauuugugaauccagauacaggcaggguucuguuugaguguaagcuucauaaaucaggauaugucacaguggcucacacuggcccgcaugauuugguuaucccccccaaugguuacuuuagauuugauuccugggucaaccaguucuacacacuugcccccaugggaaauggagcggggcguagacguuaa

SEQ ID NO: 8234 - RNA, 1614 nt, Artificial Sequence
  VP1__Norovirus_and/or_Norovirus-like__AY532135
augaagauggcgucgaaugacgccaacccaccugauggguccacagccaaccucgucccagaggucaacaaugagguuauggcuuuggagcccguuguuggugccgcuauugcggcaccuguagcgggccaacaaaauauaauugaccccuggauuagaaauaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaacaauuucuaucauuacaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggauguuacccacauugcaggcagucaugauuauacaaugaauuuggcuucucaaaauuggaacaauuaugacccaacagaagaaaucccagccccucugggaacuccagauuucgugggaaagauccaaggugugcucacccaaaccacaagagaggauggcucgacccgcgcccacaaagcuacagugagcacugggaguguccacuuuacuccaaagcugggcaguguucaauacaccacugacacaaacaaugauuuucaaacuggucaaaacacgaaguucaccccagucggcgucauccaggacgguaauaaccaucaaaaugaaccccaacaauggguacucccaaauuacucaggcagaacuggucauaaugugcaccuagcuccugccguugcccccacuuuuccgggugagcaacuucuuuucuuuagguccacuaugcccggauguagcggguaucccaacaugaaucuggauugccuacucccccaggaaugggugcagcacuucuaccaagaagcagcuccagcacaaucugauguggcucuacugagauucgugaauccagauacagguaggguucuguuugagugcaagcuccauaaaucaggcuaugucacaguggcucacacuggcccgcaugauuugguuaucccccccaaugguuacuuuagauuugauuccugggucaaccaguucuacacacuugcccccaugggaaauggagcggggcguagacguuaa

SEQ ID NO: 8235 - RNA, 1614 nt, Artificial Sequence
  VP1__Norovirus_and/or_Norovirus-like__AY532125
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggugagauacuauggagcgcgcccuugggcccugauuugaacccuuaccuuucucauuuggccagaauguacaaugguuaugcagguggcuuugaagugcagguaauccucgcggggaacgcguucaccgccgggaaagucauauuugcagcagucccaccaaauuuuccaacugaaggcuugagccccagccagguuacuauguucccccauauaauaguagauguuaggcaacuggaaccuguguugauccccuuaccugaugucaggaacaauuucuaucauuacaaucaaucaaaugauuccaccauuaaauugauagcaaugcuguauacaccacuuagggcuaauaaugcuggggaugaugucuucacagucucuugucgaguccucacaaggccaucccccgauuuugauuuuauauuuuuggugccacccacaguugaaucaagaacuaaaccguucaccgucccaauccuaacuguugaggaaauguccaauucaagguuccccaucccuuuggaaaaguuguacacgggucccagcagugcuuuuguuguccaaccacaaaauggcaggugcacgacugauggugugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugagcacugggaguguccacuuuacuccaaagcugggcaguguccaauacaccacugacacaaacaaugauuuucaaacuggccaaaacacgaaauucaccccagucggcgucauccaggacgguaauaaccaucaaaaugaaccccaacaaugggugcucccaaauuacucagguagaacuggucauaauguacaccuagcuccugccguugcccccacuuuuccgggugagcaacuucuuuucuuuagguccacuaugcccggguguagcggguauccuaacaugaaucuggauugccuacucccccaagaaugggugcagcacuucuaccaagaagcagcuccagcacaaucugauguggcucugcugagauuugugaauccagauacagguaggguucuguuugagugcaagcuucauaaaucaggcuaugucacaguggcucacacuggcccgcaugauuugguuaucccccccaaugguuacuucagauuugauuccugggucaaccaguucuacacacucgcccccaugggaaauggagcggggcguagacguuaa

SEQ ID NO: 8236 - RNA, 1614 nt, Artificial Sequence
  VP1__Norovirus_and/or_Norovirus-like__AJ277619
augaagauggcgucgaaugacgccaacccaucugauggguccacagccaaccucgucccagaggucaacaaugagguuauggcuuuggagcccguuguuggugccgcuaucgcggcaccuguagcgggccaacaaaauguaauugaccccuggauuagaaguaauuuuguacaagccccugguggagaguuuacaguauccccuagaaacgcuccaggugagauacuauggagcgcgcccuugggcccugauuugaaccccuaccuuucucauuuggccagaauguacaaugguuaugcagguggucuugaagugcagguaguccucgcgggaaacgcguucaccgccgggaaaaucauauuugcagcagucccaccaaauuuuccaacugaaggcuugagccccagccaggucacuauguucccccauauaauaguagauguuaggcaauuggaaccuguguugaucccauuaccugauguuaggaacaauuuuuaucauuacaaucaaucaaaugauucuaccauuaaauugauagcaaugcuguauacaccacuuagggccaacgaugcuggggaugaugucuucacagucucuugucgaguccucacgaggccgucccccgauuuugauuucauauucuuggugccacccacaguugaaucaagaacuaaaccauucaccgucccaaucuuaacaguugaggaaauguccaauucaagauuccccauuccuuuggaaaaguuguacacgggucccaguagugcuuuuguuguccaaccacaaaauggcaggugcacgacugauggugugcucuuagguacuacccagcugucugcugucaacaucugcaccuucagaggggaugucacccacauugcaggcagccaugauuauacaaugaauuuggcuucucaaaauuggaacaauuaugacccaacagaagaaaucccagccccucugggaacuccagauuucgugggaaagauccaaggcaugcuuucccaaaccacaagaggggaugacucgacccgcgcccacaaagccacagugagcacugggaguguccacuuuacuccaaagcugggcaguguucaauacaccacugacacaaacaaugauuuugaaacuggccaaaacacgaaauucaccccagucggcgucauccaggacgguaacaaccaucaaaaugaaccccaacaauggguacucccaaauuacucugguagaacuggucauaaugugcaccuagccccugccguugcccccacuuuuccgggcgagcaacuucuuuucuuuagauccacuaugcccggauguagcggguaucccaacaugaaucuggauugccuacucccccaggaaugggugcagcacuucuaccaagaagcagcuccagcacaaucugauguggcucugcugagauuugugaauccagacacagguaggguucuguuugagugcaagcuccauaaaucaggcuaugucacaguggcucacacuggcccgcaugauuugguuaucccccccaaugguuacuuuagauuugauuccugggucaaccaguuauacacacuugcccccaugggaaauggagcggggcguagacguuaa

SEQ ID NO: 8237 - RNA, 1614 nt, Artificial Sequence
  VP1__Norovirus_and/or_Norovirus-like__AF080556
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggugagauacuauggagcgcgcccuuaggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauucccuuaccugauguuaggaauaauuucuaucauuauaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugagcacugggaguguccacuuuacuccaaagcugggcaguguucaauacaccacugacacaaacaaugauuuucaagcuggccaaaacacgaaauucaccccagucggcgucauccaggacgguaauaaccaucaaaaugaaccccaacaauggguacucccaaauuacucaggcagaacuggucauaaugugcaccuagcuccugccguugcccccacuuuuccgggugagcaacuucuuuucuuuagguccacuaugcccggauguaguggguaucccaacaugaaucuggauugcuuacucccccaggaaugggugcagcacuucuaccaagaagcagcuccagcacaaucugauguggcucugcugagauuugugaauccagauacagguaggguucuguuugagugcaagcuccauaaaucaggcuaugucacaguggcucacacuggcccgcaugauuugguuaucccccccaaugguuauuuuagauuugauuccugggucaaccaguucuacacacuugcccccaugggaaauggagcggggcguagacguuaa

SEQ ID NO: 8238 - RNA, 1614 nt, Artificial Sequence
  VP1__Norovirus_and/or_Norovirus-like__AF080550
augaagauggcgucgaaugacgccaacccaucugauggguccacagccaaccucgucccagaggucaacaaugagguuauggcuuuggagcccguugucggugccgcuauugcggcaccuguagcgggccaacaaaauguaauugaccccuggauuagaaauaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagacguuaggcaauuggaaccuguguugauucccuuaccugauguuaggaacaauuucuaucauuacaaucaaucaagugauucuaccauuaaauugauagcaaugcuauacacaccacuuagggcuaauaaugcuggggaugaugucuuuacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcaccacugauggcgugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaauucaccccagucggcgucauccaggacgguaauaaccaucaaaaugaaccccaacaauggguacucccaaauuacucaggcagaacuggucauaaugugcaccuagcuccugccguugcccccacuuuuccgggugagcagcuucuuuucuuuagguccacuaugcccggauguagcggguaucccaauaugaaucuggauugccuacucccccaggaaugggugcagcacuucuaccaagaagcagcuccagcacaaucugauguggcucugcugagauuugugaauccagauacagguaggguucuguuugagugcaagcuccauaaaucaggcuaugucacaguggcucacacuggcccgcaugauuugguuaucccccccaaugguuacuuuagauuugauuccugggucaaccaguucuacacacuugcccccaugggaaauggagcggggcguagacguuaa

SEQ ID NO: 8239 - RNA, 1614 nt, Artificial Sequence
  VP1__Norovirus_and/or_Norovirus-like__EU078407
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuaggaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaauaauuucuaucauuacaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccguuccaaucuuaacuguugaggaaauguccaauucaagauuccccauuccuuuggaaaaguuauacacgggucccagcagugcuuuuguuguccaaccacaaaauggcaggugcacgacugauggcgugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagaggggauggcucgacccgcgcccacaaagcuacagugagcacugggaguguccacuuuacuccaaagcugggcaguguucaauucaccacugacacaaacaaugauuuucaaacuggccaaaacacgaaauucaccccagucggcgucauccaggacggugauaaccaucaaaaugaaccccaacaauggguacucccaaauuacucagguagaacuggucauaaugugcaccuagccccugccguugcccccacuuuuccgggugagcaacuucuuuucuuuagguccacuaugcccggauguagcggguaucccaacaugaaucuggauugccuacucccccaggaaugggugcagcacuucuaccaagaagcagcuccagcacaaucugauguggcucugcugagauuugugaauccagacacagguaggguucuguuugagugcaagcuccauaaaucaggcuaugucacaguggcucacacuggcccgcaugauuugguuaucccccccaaugguuacuuuagauuugauuccugggucaaccaguucuacacacuugcccccaugggaaaugggacggggcguagacguuaa

SEQ ID NO: 8240 - RNA, 1614 nt, Artificial Sequence
  VP1__Norovirus_and/or_Norovirus-like__AB083781
augaagauggcgucgaaugacgccaacccaucugauggguccacagccaaccucgucccagaggucaacaaugagguuauggcuuuggagcccguuguuggugccgcuaucgcggcaccuguagcgggccaacaaaauguaauugaccccuggauuagaaguaauuuuguacaagccccugguggagaguuuacaguauccccuagaaacgcuccaggugagauacuauggagcgcgcccuugggcccugaucugaaucccuaccuuucucauuuggccagaauguacaaugguuaugcuggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaacaauuucuaucauuauaaucaaucaaaugauucuaccauuaaauugauagcaaugcuguauacaccacuuagggcuaacaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuuaagaggggaugucacccacauugcaggcagccaugauuauacaaugaauuuggcuucucaaaauuggaacaauuaugacccaacagaagaaaucccagccccucugggaacuccagacuucgugggaaagauccaaggcaugcuuucccaaaccacaagaggggauggcucgacccgcgcccacaaagcuacagugagcacugggaguguccacuucacuccaaagcugggcaguguucaauacaccacugacacaaacaaugauuuugaaacuggccagaacacgaaauucaccccagucggcgucauccaggacgguaacaaccaucaaaaugaaccccaacaaugggugcucccaaauuacucagguagaacuggucauaaugugcaccuagccccugccguugcccccacuuuuccgggugagcaacuucuuuucuuuagauccacuaugcccggauguagcggguaucccaacaugaaucuggauugccuacucccccaggaaugggugcagcacuucuaccaagaagcagcuccagcacaaucugauguggcucugcugagauuugugaauccagacacagguaggguccuguuugagugcaagcuccauaaaucgggcuaugucacaguggcucacacuggcccgcaugauuugguuaucccccccaaugguuacuuuagauuugauuccugggucaaccaguucuacacacuugcccccaugggaaauggagcggggcguagacguuaa

SEQ ID NO: 8241 - RNA, 1614 nt, Artificial Sequence
  VP1__Norovirus_and/or_Norovirus-like__AF427122
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauucccuuaccugaugucaggaauaauuucuaucauuauaaucaaucaaaugauucuaccauuaaauugauagcaaugcuguacacaccacuuagggcuaauaaugcuggggaugaugucuucacagucucuugucgaguccucacgaggccaucccccgauuuugauuucauauucuuggugccaccaacaguugaaucaagaacuaaaccauucaccgucccaaucuuaacuguugaggaaauguccaauucaagguuccccauuccuuuggaaaaguuguacacgggccccagcagugcuuuuguuguccaaccacagaacggcaggugcacgaccgauggcgugcuccuaggcaccacccgguugucugcugucaacaucugcaccuucagaggggaugucacccacauugcaggcagucgugauuacacaaugaauuuggcuucucaaaauuggaacaauuaugacccaacagaagaaaucccagccccucugggaaccccagauuucgugggaaagauccaaggugugcucacccaaaccacaagagaggacggcucgacccgcgcccacaaagcuacagugagcacugggaguguccacuuuacuccaaagcugggcaguguucaauacaccacugauacaaacaaugauuuucaaacuggccaaaacacgaaauucaccccagucggcgucauccaggacgguaauaaccaucaaaaugaaccccaacaauggguacucccaaauuauucaggcagaacuggucacaaugugcaccuagcuccugccguugcccccacuuuuccgggugagcaacuccuuuucuuuagguccacuaugcccggauguagcggguaucccaacaugaauuuggauugccuacucccccaggaaugggugcagcacuucuaccaagaagcggcuccagcacaaucugauguggcucugcugagauuugugaauccagauacaggcaggguucuguuugaguguaagcuucauaaaucaggauaugucacaguggcucacacuggcccgcaugauuugguuaucccccccaaugguuacuuuagauuugauuccugggucaaccaguucuacacacuugcccccaugggaaauggaguggggcguagacguuaa

SEQ ID NO: 8242 - RNA, 1614 nt, Artificial Sequence
  VP1__Norovirus_and/or_Norovirus-like__AY532133
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggugagauacuauggagcgcgcccuugagcccugauuugaaccccuaccuuucucaucuggccagaauguacaacgguuaugcaggugguuuugaagugcagguaauccucgcggggaacgcguucaccgccgggaaaaucauauuugcagcagucccaccaaauuuuccaacugaaggcuugagcccuagccagguuacuauguucccccacauaauaguagauguuaggcaauuggaacccguguugauccccuuaccugauguuaggaauaacuucuaucacuacaaccaaucaaaugacucuaccauuaaauugauagcaaugcuguauacaccacuuagggcuaauaaugcuggggaugaugucuucacggucucuugucgaguccucacgaggccaucccccgauuuugauuuuauauucuuggugccacccacaguugaaucaagaauuaaaccauucaccgucccaaucuuaacuguugaggaaauguccaauucaagguuccccauuccuuuggaaaaguuguacacgggucccagcagugcauuuguuguccaaccacaaaaugguaggugcacgacugacggcgugcucuuaggcacuacccagcugucugcugucaacaucugcaccuucagaggggaugucacccacauugcaggcagccacgacuauacaaugaaucuggcuucucaaaauuggaacaauuaugacccaacagaagaaaucccagccccucugggaacuccagauuucgugggaaagauucaaggcaugcucacccaaaccacaagagaggauggcucgacccgcgcccacaaagcuacagugagcacugggaguguucacuuuacuccaaagcugggcaguguucaauacaccacugacacaaacaaugauuuucaaacuggccaaaacacgaaauucaccccagucggcgucauccaggacgguaauaaccaucaaaaugaaccucaacaauggguacucccaaauuacucagguagaacuggucauaaugugcaccuagcuccugccguugcccccacuuucccgggugagcaacuucuuuucuucagguccacuaugcccggauguagcggguaucccaauaugaaucuggauugucuacucccccaggaaugggugcagcacuuuuaccaagaagcagcuccagcgcaaucugauguggcccugcugagauuugugaauccagacacagguaggguucuguuugagugcaagcuccauaaaucaggcuaugucacaguggcucacacuggcccgcaugauuugguuaucccccccaaugguuacuuuagauuugauuccugggucaaccaguucuacacacuugcccccaugggaaauggagcggggcgcaggcguuaa

SEQ ID NO: 8243 - RNA, 1614 nt, Artificial Sequence
  VP1__Norovirus_and/or_Norovirus-like__AY532131
augaagauggcgucgaaugacgccaacccaucugauggguccacagccaaccucgucccagaggucaacaaugagguuauggcuuuggagcccguuguuggugccgcuauugcggcaccuguagcgggccaacaaaauauaauugaccccuggauuagaaauaauuuuguacaagccccugguggagaguuuacaguauccccuagaaacgcuccgggugagauacuauggagcgcgcccuugggcccugauuugaaccccuaccuuucucauuuggccagaguguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaacaauuucuaucauuacaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagguuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggauguuacccacauugcaggcagucaugauuauacaaugaauuuggcuucucaaaauuggaacaauuaugacccaacagaagaaaucccagccccucugggaacuccagauuucgugggaaagauccaagguaugcucacccaaaccacaagagaggauggcucgacccgcgcccacaaagcuacaguaagcacugggaguguccacuuuacuccaaagcugggcaguguucaauacaccacugacacaaacaaugauuuucaaacuggccaaaacacgaaguucaccccagucggcgucauccaggacgguaauaaccaucaaaaugaaccccaacaauggguacucccaaguuacucaggcagaacuggccauaaugugcaccuagcuccugccguugcccccacuuuuccgggugagcaacuucuuuucuuuagguccacuaugcccggauguagcggguaucccaacaugaaucuggauugccuacucccccaggaaugggugcagcacuucuaccaagaagcagcuccagcacaaucugauguggcucugcugagauucgugaauccagauacagguaggguucuguuugagugcaagcuccauaaaucaggcuaugucacaguggcucacacuggcccgcaugauuugguuaucccccccaaugguuacuuuagauuugauuccugggucaaccaguucuacacacuugcccccaugggaaauggagcggggcguagacguuaa

SEQ ID NO: 8244 - RNA, 1614 nt, Artificial Sequence
  VP1__Norovirus_and/or_Norovirus-like__AY532121
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggugagauacuauggagcgcgcccuugggcccugauuugaacccuuaccuuucucauuuggccagaauguacaaugguuaugcagguggcuuugaagugcagguaauccucgcggggaacgcguucaccgccgggaaagucauauuugcagcagucccaccaaauuuuccaacugaaggcuugagccccagccagguuacuauguucccccauauaauaguagauguuaggcaacuggaaccuguguugauccccuuaccugaugucaggaacaauuuuuaucauuacaaucaaucaaaugauuccaccauuaaauugauagcaaugcuguauacaccacuuagggcuaauaaugcuggggaugaugucuucacagucucuugucgaguccucacaaggccaucccccgauuuugauuuuauauuuuuggugccacccacaguugaaucaagaacuaaaccguucaccgucccaauccuaacuguugaggaaauguccaauucaagguuccccaucccuuuggaaaaguuguacacgggucccagcagugcuuuuguuguccaaccacaaaauggcaggugcacgacugauggugugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcacgcucacccaaaccacaagagaggauggcucgacccgcgcccacaaagcuacagugagcacugggaguguccacuuuacuccaaagcugggcaguguccaauacaccacugacacaaacaaugauuuucaaacuggccaaaacacgaaauucaccccagucggcgucauccaggacgguaauaaccaucaaaaugaaccccaacaaugggugcucccaaauuacucagguagaacuggucauaaugugcaccuagcuccugccguugcccccacuuuuccgggugagcaacuucuuuucuuuagguccacuaugcccggguguagcggguaucccaacaugaaucuggauugccuacucccccaagaaugggugcagcacuucuaccaagaagcagcuccagcacaaucugauguggcucugcugagauuugugaauccagauacagguaggguucuguuugagugcaagcuucauaaaucaggcuaugucacaguggcucacacuggcccgcaugauuugguuaucccccccaaugguuacuucagauuugauuccuggaucaaccaguucuacacacucgcccccaugggaaauggagcggggcguagacguuaa

SEQ ID NO: 8245 - RNA, 1614 nt, Artificial Sequence
  VP1__Norovirus_and/or_Norovirus-like__AY532115
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguguccccuagaaacgcuccgggugagauacuauggagcgcgcccuugggcccugauuugaaccccuaccuuucccauuuggccagaauguacaaugguuaugcaggugguuuugaugugcagguaauccucgcggggaacgcguucaccgccgggaaaaucauauuugcagcagucccaccaaauuuuccaacugaaggcuugagccccagccaggucacuauguucccccauauaauaguagauguuaggcaauuggaaccuguguugauccccuuaccugauguuaggaacaauuuuuaccauuacaaucaaucaaaugauucuaccauuaaauugauagcaaugcuguauacaccacuuagggccaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggugugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugagcacugggaguguccacuuuacuccaaagcugggcaguguccaauacaccacugacacaaacaaugauuuucaaacuggccaaaacacgaaauucaccccagucggcgucauccaggacgguaauaaccaucaaaaugaaccccaacaaugggugcucccaaauuacucagguagaacuggucauaaugugcaccuagccccugccguugcccccacuuucccgggugagcaacuucuuuucuuuagguccacuaugcccggauguagcggguaucccaacaugaaucuggauugccuacucccccaggaaugggugcagcacuucuaccaagaagcagcuccagcacaaucugauguggcucugcugagauuugugaauccagacacagguaggguucuguuugagugcaagcuccauaaaucaggcuaugucacaguggcucauacuggcccgcaugauuugguuaucccccccaaugguuacuuuagauuugauucuugggucaaccaguuuuacacacuugcccccaugggaaauggagcggggcguagacguuaa

SEQ ID NO: 8246 - RNA, 1614 nt, Artificial Sequence
  VP1__Norovirus_and/or_Norovirus-like__KF806530
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccacauaguaguagauguuagacaacuggaaccuguguugauccccuuacccgaugucaggaauaauuucuaccacuauaaucaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauuuuaacuguugaggaaaugaccaauucaagguuccccauuccuuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuugcaggcacccacgaauacgcaaugaauuuggcuucucaaaauuggaauaauuaugacccaacagaagaaaucccagccccucugggagccccagauuucgugggaaagauccgaggugugcucacucaaaccacaaggagggacgguucaacccgcggccacagggcuacauugagcacugggagcgcccacuucacuccaaagcugggcagcauucgguuuuccacugacacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggccccugcuuuuccgggugagcaacugcuuuucuucagguccaccaugcccggaugcagcggguaucccaacaugaauuuggauugucuacuuccacaggaaugggugcagcacuucuaucaagaggcagccccagcacaaucugauguggcucugcuaagauuugugaacccagauacaagcaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacguuaa

SEQ ID NO: 8247 - RNA, 1614 nt, Artificial Sequence
  VP1__Norovirus_and/or_Norovirus-like__KF806513
augaagauggcgucgaaugacgccagcccaucugauggguccgcagccaaccucgucccagaggucagcaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccaauucaagguuccccauucccuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuuacaggcaccuccgaauacgcaaugaauuuggcuucucaaaauuggaauaauuaugacccaacagaagaaaucccagccccucugggagccccagauuucgugggaaagauccgagguaugcucacucaaaccacaaggagggacgguucgacccgcggccacagggcuacauugagcacugggagcgcccacuucacuccaaagcugggcagcauucgguuuuccacugauacaaacaaugauuuugaagcuagccaaaacacgaaauucaccccagucggugucuuccaggaaggcgacaaccaccaaaaugaaccccaacaaugggugcucccaaauuauucaggugcaacugcccacaauguacaccuugccccugccguggcccccgcuuuuccgggugagcaacugcucuucuucagguccaccaugcccggauguggcggguaucccaacaugaauuuggauugucuacucccacaggaaugggugcagcacuucuaucaagaggcagccccagcacaaucugacguggcucugcuaagauuugugaauccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacguuaa

SEQ ID NO: 8248 - RNA, 1614 nt, Artificial Sequence
  VP1__Norovirus_and/or_Norovirus-like__AY741811
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggugagauacuauggagcgcgcccuugggcccugauuugaacccuuaccuuucucauuuggccagaauguacaaugguuaugcagguggcuuugaagugcagguaauccucgcggggaacgcguucaccgccgggaaagucauauuugcagcagucccaccaaauuuuccaacugaaggcuugagccccagccagguuacuauguucccccauauaauaguagauguuaggcaacuggaaccuguguugauccccuuaccugaugucaggaacaauuucuaucauuacaaucaaucaaaugauuccaccauuaaauugauagcaaugcuguauacaccacuuaaggcuaauaaugcuggggaugaugucuucacagucucuugucgaguccucacaaggccaucccccgauuuugauuuuauauuuuuggugccacccacaguugaaucaagaacuaaaccguucaccgucccaauccuaacuguugaggaaauguccaauucaagguuccccaucccuuuggaaaaguuguacacgggucccagcagugcuuuugucguccaaccacaaaauggcaggugcacgacugauggugugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugagcacugggaguguccacuuuacuccaaagcugggcaguguccaauacaccacugacacaaacaaugauuuucaaacuggccaaaacacgaaauucaccccagucggcgucauccaggacgguaauaaccaucaaaaugaaccccaacaaugggugcucccaaauuacucagguagaacuggucauaauguacaccuagcuccugccguugcccccacuuuuccgggugagcaacuucuuuucuuuagguccacuaugcccggguguagcggguauccuaacaugaaucuggauugccuacucccccaagaaugggugcagcacuucuaccaagaagcagcuccagcacaaucugauguggcucugcugagauuugugaauccagauacagguaggguucuguuugagugcaagcuucauaaaucaggcuaugucacaguggcucacacuggcccgcaugauuugguuaucccccccaaugguuacuucagauuugauuccugggucaaccaguucuacacacucgcccccaugggaaauggagcggggcguagacguuaa

SEQ ID NO: 8249 - RNA, 1614 nt, Artificial Sequence
  VP1__Norovirus_and/or_Norovirus-like__AY532122
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggugagauacuauggagcgcgcccuugggcccugauuugaacccuuaccuuucucauuuggccagaauguacaaugguuaugcagguggcuuugaagugcagguaauccucgcggggaacgcguucaccgccgggaaagucauauuugcagcagucccaccaaauuuuccaacugaaggcuugagccccagccagguuacuauguucccccauauaauaguagauguuaggcaacuggaaccuguguugauccccuuaccugaugucaggaacaauuucuaucauuacaaucaaucaaaugauuccaccauuaaauugauagcaaugcuguauacaccacuuagggcuaauaaugcuggggaugaugucuucacagucucuugucgaguccucacaaggccaucccccgauuuugauuuuauauuuuuggugccacccacaguugaaucaagaacuaaaccguucaccgucccaauccuaacuguugaggaaauguccaauucaagguuccccaucccuuuggaaaaguuguacacgggucccagcagugcuuuuguuguccaaccacaaaauggcaggugcacgacugauggugugcucuuaggcacuacccagcugucugcugucaacaucugcaccuucggaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugagcacugggaguguccacuuuacuccaaagcugggcaguguccaauacaccacugacacaaacaaugauuuucaaacuggccaaaacacgaaauucaccccagucggcgucauccaggacggugauaaccaucaaaaugaaccccaacaaugggugcucccaaauuacucagguagaacuggucauaauguacaccuagcuccugccguugcccccacuuuuccgggugagcaacuucuuuucuuuagguccacuaugcccggguguagcggguauccuaacaugaaucuggauugccuacucccccaagaaugggugcagcacuucuaccaagaagcagcuccagcacaaucugauguggcucugcugagauuugugaauccagauacagguaggguucuguuugagugcaagcuucauaaaucaggcuaugucacaguggcucacacuggcccgcaugauuugguuaucccccccaaugguuacuucagauuugauuccugggucaaccaguucuacacacucgcccccaugggaaauggagcggggcguagacguuaa

SEQ ID NO: 8250 - RNA, 1614 nt, Artificial Sequence
  VP1__Norovirus_and/or_Norovirus-like__AY532120
augaagauggcgucgaaugacgccaacccaucugauggguccacagccaaccucgucccagaggucaacaaugagguuauggcuuuggagcccguuguuggugccgcuauugcggcaccuguagcgggccaacaaaauauaauugaccccuggauuagaaauaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaacaguuucuaucauuacaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggauguuacccacauugcgggcagucaugauuauacaaugaauuuggcuucucaaaauuggaacaauuaugacccaacagaagaaaucccagccccucugggaacuccagauuucgugggaaagauccaagguaugcucacccaaaccacaagagaggauggcucgacccgcgcccacaaagcuacagugagcacugggaguguccacuuuacuccaaagcugggcaguguucaauacaccacugacacaaacagugauuuccaaacuggccaaaacacgaaguucaccccagucggcgucauccaggacgguaauaaccaucaaaaugaaccccaacaauggguacucccaaauuacucaggcggaacuggucauaaugugcaccuagcuccugccguugcccccacuuuuccgggugagcaacuucuuuucuuuagguccacuaugcccggauguagcggguaucccaacaugaauuuggauugcuacuccccccaggaaugggugcagcacuucuaccaagaagcagcuccagcacaaucugauguggcucuguugagauucgugaauccagauacagguaggguucuguuugagugcaagcuccauaaaucaggcuaugucacaguggcucacacuggcccgcaugacuugguuaucccccccaaugguuacuuuagauuugauuccugggucaaccaguucuacacacuugcccccaugggaaauggagcggggcguagacguuaa

SEQ ID NO: 8251 - RNA, 1614 nt, Artificial Sequence
  VP1__Norovirus_and/or_Norovirus-like__AY532111
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggugagauacuauggagcgcgcccuugagcccugauuugaaccccuaccuuucucauuuggccagaauguacaaugguuaugcaggugguuuugaagugcagguaauccucgcggggaacgcguucaccgcggggaaaaucauauuugcagcagucccaccaaauuuuccaacugaaggcuugagccccagccagguuacuauguuuccccauauaauaguagauguuaggcaauuggaaccuguguugauucccuuaccugauguuaggaacaauuucuaccauuacaaucaaucaaaugauucuaccaucaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcuccuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaguucaccccagucggcgucauccaggacgguaauaaccaucaaaaugaaccccaacaauggguacucccaaauuacucaggcagaacuggucauaaugugcaccuagcuccugccguugcccccacuuuuccgggugagcaacuucuuuucuuuagguccacuaugcccggauguagcggguaucccaacaugaaucuggauugccuacucccccaggaauggguacagcacuucuaccaagaagcagcuccagcacaaucugauguggcucugcuaagauuugugaauccagauacagguaggguucuguuugaguguaagcuccauaaaucaggcuauguuacaguggcucacacuggcccgcaugauuugguuaucccccccaaugguuacuuuagauuugauuccugggucaaccagguuuacacacuugcccccaugggaaauggagcggggcguagacguuaa

SEQ ID NO: 8252 - RNA, 1614 nt, Artificial Sequence
  VP1__Norovirus_and/or_Norovirus-like__AF080558
augaagauggcgucgaaugacgccaacccaucugauggguccacagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguguccccuaggaacgcuccgggugagauacuauggagcgcgcccuugggcccugauuugaaccccuaccuuucucacuuggccagaauguauaaugguuaugcaggugguuuugaagugcagguaauccucgcggggaacgcguucaccgccgggaaaaucauauuugcagcagucccaccaaacuuuccaacugaaggcuugagccccagccagguuacuauguucccacauauaauaguagauguuaggcaauuggaaccuguguuaauccccuuaccugacguuaggaauaauuucuaccauuacaaucaaucaaaugauucuaccauuaaauugauagcaaugcuguauacaccacuuagggccaauaaugcuggggaugaugucuucacagucuccugucgaguccucacgaggccaucccccgauuuugauuucauauucuuggugccacccacaguugagucaagaacuaaaccauucaccgucccaaucuuaacuguugaggaaauguccaauucaagguuccccaucccuuuggaaaaguuguacacgggucccagcagugcuuuuguuguccaaccacaaaauggcaggugcacgacugauggcguacucuuaggcacuacccagcugucugcugucaacaucugcaccuucagaggggaugucacccacauugcaggcagccaugacuauacaaugaauuuggcuucucaaaauuggaacaauuaugacccaacagaagaaaucccagccccucugggaacuccagauuucgugggaaagauccaaggcaugcucacccaaaccacgagaggggauggcucgacccgcgcccacaaagcuacagugagcacugggaguguccacuuuacuccaaagcugggcaguguucaauucaccacugacacaaacaaugauuuucaaacuggccaaaacacgaaauucacuccagucggcgucacccaggacggugauaaccaucaaaaugaaccccagcaauggguacucccaaauuacucagguagaacuggucauaaugugcaccuagccccugccguugcccccacuuuuccgggugagcaacuucuuuucuuuagguccacuaugcccggauguagcggguaccccaacaugaaucuggauugccuacucccccaagaaugggugcagcacuucuaccaagaagcagcuccagcacaaucugauguggcucugcugagauuugugaauccagacacaggcaggguucuguuugagugcaagcuccauaaaucaggcuaugucacaguggcucacacuggcccgcacgauuuggucaucccccccaaugguuauuuuagauuugauucuugggucaaucaguucuacacacuugcccccaugggaaauggagcggggcguagacguuaa

SEQ ID NO: 8253 - RNA, 1614 nt, Artificial Sequence
  VP1__Norovirus_and/or_Norovirus-like__KF806508
augaagauggcgucgaaugacgccagcccaucugauggguccgcagccaaccucgucccagaggucagcaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauucccuuacccgaugucaggaauaauuucuaccacuacaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccaauucaagguuccccauucccuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuuacaggcaccuccgaauacgcaaugaauuuggcuucucaaaauuggaauaauuaugacccaacagaagaaaucccagccccucugggagccccagauuucgugggaaagauccgagguaugcucacucaaaccacaaggagggacgguucgacccgcggccacagggcuacauugagcacugggagcgcccacuucacuccaaagcugggcagcauucgguuuuccacugauacaaacaaugauuuugaagcuggccaaaacacgaaauucaccccagucgguaucuuccaggaaggcgacaaccaccaaaaugaaccccaacaaugggugcucccaaauuauucaggugcaacugcccacaauguacaccuugccccugccguggcccccgcuuuuccgggugagcaacugcucuucuucagguccaccaugcccggauguggcggguaucccaacaugaauuuggauugucuacucccacaggaaugggugcagcacuucuaucaagaggcagccccagcacaaucugacguggcucugcuaagauuugugaauccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacguuaa

SEQ ID NO: 8254 - RNA, 1614 nt, Artificial Sequence
  VP1__Norovirus_and/or_Norovirus-like__AF425766
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuauacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauucccuuaccugaugucaggaauaacuucuaccauuauaaccaaucaaaugauucuaccauuaaauugauagcaaugcuguacacaccacuuagggcuaauaaugcuggggaugaugucuucacagucucuugucgaguccucacgaggccaucccccgauuuugauuucauauucuuggugccaccaacaguugaaucaagaacuaaaccauucaccgucccaaucuuaacuguugaggaaauguccaauucaagauuccccauuccuuuggaaaaguuguacacgggucccagcagugcuuuuguuguccaaccacagaacggcaggugcacgacugauggcgugcuccuaggcaccacccagcugucugcugucaacaucugcaccuucagaggggaugucacccacauugcaggcagucaugacuacacaaugaauuuggcuucucaaaauuggaacaauuaugacccaacagaagaaaucccagccccucugggaaccccagaucucgugggaaagauccaagguaugcucacccaaaccacaagagaggauggcucgacccgcgcccacaaagcuacagugagcacugggaguguccacuuuacuccaaagcugggcaguguucaauacaccaccgauacaagcaaugauuuucaaacuggccaaaacacgaaauucaccccagucggcgucauccaggacgguaauaaccaccaaaaugaaccccaacaauggguacucccaaauuauucaggcagaacuggucacaaugugcaccuagcuccugccguugcccccacuuuuccgggugagcaacuccuuuucuuuagguccacuaugcccggauguagcggguaucccaacaugaaucuggauugccuacucccccaggaaugggugcagcacuucuaccaagaagcggcuccagcacaaucugauguggcucugcugagauuugugaauccagauacaggcaggguucuguuugaguguaagcuccacaaaucaggauaugucacaguggcucacacuggcccgcaugauuugguuaucccccccaaugguuacuuuagauuugauuccugggucaaccaguucuacacacuugcccccaugggaaauggagcggggcguagacguuaa

SEQ ID NO: 8255 - RNA, 1614 nt, Artificial Sequence
  VP1__Norovirus_and/or_Norovirus-like__AJ583672
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguaucccccagaaacgcuccaggugaaauacuauggagcgcgcccuugggcccugaucugaaucccuaccuuucucacuuggccagaauguacaaugguuaugcaggugguuuugaagugcagguaauucucgcggggaacgcguucaccgccgggaaaaccauauuugcagcagucccaccaaacuucccaacugaaggcuugagccccagccaggucacuauguucccccauauaauaguagauguuaggcaaccggaaccuguguugauccccuuaccugauguuaggaauaauuucuaucacuacaaucaaucaaaugacccuacuauaaaauugauagcaaugcuguacacaccacuuagggcuaauaaugcuggggaugaugucuucacagucucuugucgaguccucaccagaccaucccccgauuuugauuucauauuuuuggugccacccacaguugagucaagaacuaaaccauucaccgucccaauuuuaacuguugaggaaaugaccaauucaagauuccccauuccuuuggaaaaguuauucacgggucccagcaaugccuuuguuguucaaccacaaaauggcaggugcacgaccgauggcgugcucuuaggcacuacccaacugucuccugucaacaucugcaccuucagaggggaugucacccacauugcagguacccaugauuacacaaugaauuuggcuucucaaaauuggaacaauuaugacccaacagaagaaaucccagccccucugggaacuccagauuucgugggaaagauccaaggcgugcucucccaaaccacaaggggggauggcucgacccgcggccacaaagcuacagugagcacugggaguguccacuucacuccaaagcugggcaguguucaauacaccacugacacaaacaaugaucuugaagcuggccaaagcacgaaauuuaccccagucggugucguccaggaugguaauaaccaccaaaaugaaccccaacaaugggugcucccaaauuacucagguagaacuggucauaaugugcaccuagucccugccguagcccccacuuuuccgggugagcaacuucuuuucuucagguccacuaugcccggaugcagcggguaucccaacaugaauuuggauugucuacucccccaggaaugggugcagcacuucuaccaagaggcagcuccagcacaaucugauguggcucugcugagauuugugaauccagacacaggcaggguucuguuugagugcaagcuucauaaaucaggcuacgucacaguagcucacacuggcccgcaugauuugguuauuccucccaauggcuacuuuagauuugauuccugggucaaccaauucuacacacuugcccccaugggaaacggaacggggcguagacguuaa

SEQ ID NO: 8256 - RNA, 1614 nt, Artificial Sequence
  VP1__Norovirus_and/or_Norovirus-like__AY532119
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggugagauacuauggagcgcgcccuugggcccugauuugaaccccuaccuuucucauuuggccagaauguacaacgguuaugcaggugguuuugaagugcagguaauccucgcggggaaugcguucaccgccgggaaaaucauauuugcagcagucccaccaaauuuuccaacugaaggcuugagccccagccagguuacuauguucccccacauaauaguagauguuaggcaacuggaacccguguugauccccuuaccugauguuaggaauaauuuuuaucauuacaaccaaucaaaugauucuaccauuaaauugauagcaaugcuguauacaccacuuagggcuaauaaugcuggggaugaugucuucacggucucuugucgaguccucacgaggccaucccccgauuuugauuuuauauucuuggugccccccacagucgaaucaagaacuaaaccauucaccgucccaaucuuaacuguugaggaaauguccaauucaagauuccccauuccuuuggaaaaguuguacacgggucccaguagugcauuuguuguccaaccacaaaauggcaggugcacgacugacggugugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaagguaugcucacccaaaccacaagagaggauggcucgacccgcgcccacaaagcuacagugagcacugggaguguccacuuuacuccaaagcugggcaguguucaauacaccacugacacaaacagugauuuucaaacuggccaaaacacgaaauucaccccagucggcgucauccaggacgguaauaaccaucaaaaugaaccccagcaaugggugcucccaaauuauucagguagaacuggucauaaugugcaccuagcuccugccguugcccccacuuucccgggugagcaacuucuuuucuucagguccacuaugcccggauguagcggguaucccaacaugaaucuggauugucugcucccccaggaaugggugcagcacuuuuaccaagaagcggcuccagcgcaaucugauguggcucuguugagauuugugaauccagacacagguaggguucuguuugagugcaagcuccauaaaucaggcuaugucacaguggcucacacuggcccgcaugauuugguuaucccccccaaugguuacuuuagauuugauuccugggucaaccaguucuauacacuugcccccaugggaaauggagcggggcgcagacguuaa

SEQ ID NO: 8257 - RNA, 1614 nt, Artificial Sequence
  VP1__Norovirus_and/or_Norovirus-like__AF080552
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggugagauacuauggagcgcgcccuuaggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauucccuuaccugauguuaggaauaauuucuaucauuauaaucaaucaaaugauucuaccauuaaauugauagcaaugcuguauacaccacuuagggcuaauaaugcuggggaugaugucuucacagucucuugucgaguccucacgaggccaucccccgauuuugauuuuauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaauucaccccagucggcgucauccaggacgguaacaaucaucaaaaugaaccccaacaauggguacucccaaauuacucaggcagaacuggucauaaugugcaccuagcuccugccguugcccccacuuuuccgggugagcaacuucuuuucuuuagguccaccaugcccggauguaguggguaucccaacaugaaucuggauugcuuacucccccaggaaugggugcagcacuucuaucaagaagcagcuccagcacaaucugauguggcucugcugagauuugugaauccagauacagguaggguucuguuugagugcaagcuccauaaaucaggcuaugucacaguggcucacacuggcccgcaugauuugguuaucccccccagugguuauuuuagauuugauuccugggucaaccaguucuacacacuugcccccaugggaaauggagcggggcguagacguuaa

SEQ ID NO: 8258 - RNA, 1614 nt, Artificial Sequence
  VP1__Norovirus_and/or_Norovirus-like__KX514177
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucaccguauccccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggacaacucaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggagugccaauuucacuccaaagcugggcaaaguucaauuugaaacugauacaggcgaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8259 - RNA, 1614 nt, Artificial Sequence
  VP1__Norovirus_and/or_Norovirus-like__KF806514
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccaauucaagguuccccauucccuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuuacaggcaccuccgaauacgcaaugaauuuggcuucucaaaauugggauaauuaugacccaacagaagaaaucccagccccucugggagccccagauuuugugggaaagauccgagguaugcucacucaaaccacaaggagggacgguucgacccgcggccacagggcuacauugagcacugggagcgcccacuucacuccaaagcugggcaacauucgguuuuccacugauacaaacaaugauuuugaagcuggccaaaacacgaaauucaccccagucggugucuuccaggaaggcgacaaccaccaaaaugaaccccaacaaugggugcucccaaauuauucaggugcaacugcccacaauguacaccuugccccugccguggcccccgcuuuuccgggugagcaacugcucuucuucagguccaccaugcccggauguggcggguaucccaacaugaauuuggauugucuacucccacaggaaugggugcagcacuucuaucaagaggcagccccagcacaaucugacguggcucugcuaagauuugugaauccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacguuaa

SEQ ID NO: 8260 - RNA, 1614 nt, Artificial Sequence
  VP1__Norovirus_and/or_Norovirus-like__AB303925
augaagauggcgucgaaugacgccaacccaucugauggguccacagccaaccucgucccagaggucaacaaugagguuauggcuuuggagcccguuguuggugccgcuaucgcggcaccuguagcgggccaacaaaauguaauugaccccuggauuagaaauaauuuugugcaagccccugguggagaguuuacaguauccccuagaaacgcuccgggugagauccuauggagcgcgcccuugggcccugauuugaaccccuaccuuucucauuuggccagaauguacaaugguuaugcaggugguuuugaagugcagguaauccucgcggggaaugcguucaccgccgggaaaaucauauucgcagcagucccaccaaauuuuccaacugaaggcuugagccccagccaggucacuauguucccccauauaauaguagauguuaggcaauuggaaccuguguugauccccuuaccugauguuaggaacaauuucuaccauuauaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaacucaagauuccccauuccuuuggaaaaguuguucacgggucccagcagcgcuuuuguuguccaaccacaaaauggcaggugcacaacugauggcgugcucuuaggcacuacccagcugucugcugucaacaucugcaccuucagaggggaugucacccacauugcgggcagucaugauuauacaaugaauuuggcuucucaaaauuggaacaauuaugacccaacagaagagaucccagccccucugggaacuccagacuucgugggaaagauccaaggcaugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaauuuaccccagucggcgucauccaggacgguaauaaccaucaaaaugaaccccaacaaugggugcucccaaauuauucagguagaacuggucacaaugugcaccuagcuccugccguugcccccacuuuuccgggugagcaacuucuuuucuuuagguccacuaugcccggauguagcggguaucccaacauggaucuggauugccuacucccccaggaaugggugcagcacuucuaccaagaagcagcuccagcacaaucugauguggcucugcugagauuugugaauccagacacagguaggguuuuguuugagugcaagcuccauaaaucaggcuaugucacaguggcucacacuggcccgcaugauuugguuauccccccuaaugguuacuuuagauuugauuccuggaucaaccaguucuacacacuugcccccaugggaaauggagcggggcgcaggcguuaa

SEQ ID NO: 8261 - RNA, 1614 nt, Artificial Sequence
  VP1__Norovirus_and/or_Norovirus-like__KF806534
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugauuugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccacauaguaguagaugucagacaacuggaaccuguguugauccccuuacccgaugucaggaauaauuucuaccacuacaaucaaucaaaagaccccaccaucaaauugauagcaaugcuguacacaccacuuagggcuaauaaugcuggggaagaugucuucacagucucuugccgaguccucacgagaccaucccccgauuuugauuucauauucuuggugccacccacaguugagucaagaucaaaaccauucaccgucccaauucuaacuguugaggaaaugaccaauucaagguuccccauuccuuuggaaaagcuguucacgggucccagcagugccuuuguuguccaaccacaaaauggcaggugcacgacugauggcgugcucuuaggcaccacccaacugucucccgucaacaucugcaccuucagaggggaucucacccacuuugcaggcaccuccgaauacgcaaugaauuuggcuucucaaaauuggacuaauuaugacccaacagaagaaaucccagccccucugggagccccagauuucgugggaaagauccgaggugugcucacucaaaccacaaggagggacgguucaacccgcggccacagggcuacacugagcacugggagcgcccacuucacuccaaagcugggcagcauucgguuuuccacugauacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggcccccgcuuuuccgggugagcaacugcuuuucuucagguccaccaugcccggaugcagcggguaucccaacaugaauuuggauugucuacuuccacaggaaugggugcagcacuucuaucaagaggcagccccagcacaaucugacguggcucugcuaagauuugugaacccagauacaaguaggguuuuguuugagugcaagcuccauaaaucaggcuaugucacaguggcccauacuggccagcaugauuugguuauccccccuaaugguuacuuuagauuugauuccugggucaaccaauucuacacacuugcccccaugggaaauggaacggggcguagacguuaa

SEQ ID NO: 8262 - RNA, 1614 nt, Artificial Sequence
  VP1__Norovirus_and/or_Norovirus-like__KF806519
augaagauggcgucgaaugacgccagcccaucugauggguccgcagccaaccucgucccagaggucaacaaugagguuauggcuuuggagcccguuguuggugccacaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugucacccacaguugagucaagaucaaaaccauucaccgucccaauucuaacuguugaggaaaugaccaauucaagguuccccauucccuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuuacaggcaccuccgaauacgcaaugaauuuggcuucucaaaauuggaauaauuaugacccaacagaagaaaucccagccccucugggagccccagauuuugugggaaagauccgagguaugcucacucaaaccacaaggagggacgguucgacccgcggccacagggcuacauugagcacugggagcgcccacuucacuccaaagcugggcaacauucgguuuuccacugauacaaacaaugauuuugaggcuggccaaaacacgaaauucaccccagucggugucuuccaggaaggcgacaaccaccaaaaugaaccccaacaaugggugcucccaaauuauucaggugcaacugcccacaauguacaccuugccccugccguggcccccgcuuuuccgggugagcaacugcucuucuucagguccaccaugcccggauguggcggguaucccaacaugaauuuggauugucuacucccacaggaaugggugcagcacuucuaucaagaggcagccccagcacaaucugacguggcucugcuaagauuugugaauccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacguuaa

SEQ ID NO: 8263 - RNA, 1614 nt, Artificial Sequence
  VP1__Norovirus_and/or_Norovirus-like__AB303924
augaagauggcgucgaaugacgccaacccaucugauggguccacagccaaccucgucccagaggucaacaaugagguuauggcuuuggagcccguuguuggugccgcuaucgcggcaccuguagcgggccaacaaaauguaauugaccccuggauuagaaauaauuuugugcaagccccugguggagaguuuacaguguccccuagaaacgcuccgggugagauccuuuggagcgcgcccuugggcccugauuugaaccccuaccuuucucauuuggccagaauguacaaugguuaugcaggugguuuugaagugcagguaauccucgcggggaaugcguucaccgccgggaaaaucauauuugcagcagucccaccaaauuuuccaacugaaggcuugagccccagccagguuacuauguucccccauauaauaguagauguuaggcaauuggaaccuguguugaucccuuuaccugauguuaggaauaauuucuaucauuauaaucaaucaaaugauucuaccauuaaauugauagcaaugcuguauacaccacuuagggcuaauaaugcuggggaugaugucuucacagucuuuuguagaguccucacgaggccaucccccgauuuugauuucauauucuuggugccacccacaguugaaucaagaacuaaaccauucaccgucccaaucuuaacuguugaggaaauguccaacucaagauuccccauuccuuuggaaaaguuguacacgggucccagcagcgcuuuuguuguccaaccacaaaauggcaggugcacaacugauggcgugcucuuaggcacuacccagcugucugcugucaacaucugcaccuucagaggggaugucacccacauugcgggcagucaugauuauacaaugaauuuggcuucucaaaauuggaacaauuaugacccaacagaagagaucccagccccucugggaacuccagacuucgugggaaagauccaaggcaugcucacccaaaccacaagagaggauggcucgacccgcgcccacaaagcuacagugagcacugggaguguccacuuuacuccaaagcugggcaguguucaauacaccacugauacaaacaaugauuuucaaacuggccaaaacacgaaauuuaccccagucggcgucauccaggacgguaauaaccaucaaaaugaaccccaacaauggguacucccaaauuauucagguagaacuggucacaaugugcaccuagcuccugccguugcccccacuuuuccgggugagcagcuucuuuucuuuagguccacuaugcccggauguagcggguaucccaacaugaaucuggauugccuacucccccaggaaugggugcagcacuucuaccaagaagcagcuccagcacaaucugauguggcucugcugagauuugugaauccagacacagguaggguuuuguuugagugcaagcuccauaaaucaggcuaugucacaguggcucacacuggcccgcaugauuugguuaucccccccaaugguuacuuuagauuugauuccugggucaaccaguucuacacacuugcccccaugggaaauggagcggggcguagacgcuaa

SEQ ID NO: 8264 - RNA, 1614 nt, Artificial Sequence
  VP1__Norovirus_and/or_Norovirus-like__DQ975270
augaagauggcgucgaaugacgccaacccaucugauggguccacagccaaccucgucccagaggucaacaaugagguuauggcuuuggagcccguuguuggugccgcuauugcggcaccuguggcgggccaacaaaauguaauugaccccuggauuagaaauaauuuuguacaagccccugguggagaguuuacaguguccccuagaaacgcuccgggugagauacuauggagcgcgccuuugggcccugauuugaaccccuaccuuucucauuuggccagaacguacaaugguuaugcaggugguuuugaagugcagguaauccucgcggggaacgcguucaccgccgggaaaaucauauuugcagcagucccaccaaauuuuccaacugaaggcuugagccccagccagguuaccauguucccccauauaauaguagauguuaggcaauuggaacccguguugauccccuuaccugauguuaggaauaacuucuaucauuacaaucaaucaaaugauucuaccauuaaauugauagcaaugcuguauacaccacuuagggcuaauaaugcuggggaugacgucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggaugucacccacauugcaggcagucaugacuauacaaugaauuuggcuucucaaaauuggaacaauuaugacccgacagaagaaaucccagccccucugggaacuccagauuucgugggaaagauccaaggcaugcucacccaaaccacaagagaggaugguucgacccgcgcccacaaagcuacagugagcacugggaguguccacuuuacuccaaagcugggcaguguucaauacaccacugacacaaacaaugauuuucaaacuggccaaaacacgaaauucaccccagucggcgucauccaggacgguaauaaccaucaaaaugaaccccaacaaugggugcucccaaauuacucagguagaacuggucauaaugugcaucuagcuccugccguugcccccacuuucccgggugagcaacuucuuuucuuuagguccacuaugcccggauguagcggguaucccaacaugaaccuggauugccuacucccccaggaaugggugcagcauuucuaccaagaagcagcuccagcacaaucugauguggcucugcugagauuugugaauccagacacaggcaggguucuguuugagugcaagcuccauaaaucaggcuaugucacaguggcucacacuggcccgcaugauuugguuauccccccaaaugguuacuucagauuugauuccugggucaaccaguucuacacacuugcccccaugggaaauggagcggggcgcagacguuaa

SEQ ID NO: 8265 - RNA, 1614 nt, Artificial Sequence
  VP1__Norovirus_and/or_Norovirus-like__AF414424
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggcgagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaacuuuccaacugaaggcuugagccccagccaggucacuauguucccccauauaauaguagauguugggcaauuggaaccuguguugauccccuuaccugauguuaggaacaauuucuaucauuacaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuugucguccaaccacaaaauggcaggugcacgacugauggcgugcucuuagguacuacccagcugucugcugucaacaucugcaccuucagaggggaugucacccacauugcaggcagucaugacuauacaaugaauuuggcuucucaaaauuggaacaauuaugacccaacagaagaaaucccagccccucugggaacuccagauuucgugggaaagauccaaggcgugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaauucaccccagucggcgucauucaggacgguaauaaccaucaaaaugaaccccaacaauggguacucccaaauuacucagguagaacuggucauaauguacaccuagcuccugccguugcccccacuuuuccgggugagcaacuucuuuucuuuagguccacuaugcccggauguagcggguaucccaacaugaaucuggauugccuacucccccaggaaugggugcagcacuucuaccaagaagcagcaccagcacaaucugauguggcucuacugagauuugugaauccagauacagguaggguucuguuugagugcaagcuccauaaaucaggcuaugucacaguggcucacacuggcccgcaugauuugguuaccccccccaaugguuacuuuagauuugauucuugggucaaccaguucuacacacuugcccccaugggaaauggagcggggcguagacguuaa

SEQ ID NO: 8266 - RNA, 1614 nt, Artificial Sequence
  VP1__Norovirus_and/or_Norovirus-like__LC048964
augaagauggcgucgaaugacgccaacccaucugauggguccacagccaaccucgucccagaggucaacaaugagguuauggcuuuggagcccguuguuggugccgcuaucgcggcaccuguagcgggccaacaaaauguaauugaccccuggauuagaaguaauuuuguacaagccccugguggagaguuuacaguauccccuagaaacgcuccaggugagauacuauggagcgcgcccuugggcccugauuugaaucccuaucuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaacaauuucuaucauuacaaccaaucaaaugauucuaccauuaaauugauagcaaugcuguauacaccacuuagggcuaacaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggacccagcagugcuuuuguuguccaaccacaaaauggcaggugcacgacugauggcgugcuccuaggcacuacccagcugucugcugucaacaucugcaccuucagaggggaugucacccacauugcaggcagccaugauuauacaaugaauuuggcuucucaaaauuggaacaauuaugacccaacagaagaaaucccagccccucugggaacuccagacuucguaggaaagaaccaaggcuugcucucccaaaccacaagaggggauggcucuacccgcgcccacaaagcuacagugagcacugggaguguccacuucacuccaaagcugggcaguguucaauacaccacugacacaaacaaugauuuugaaacuggccaaaacacaaaauucaccccagucggcgucauccaggacgguaauaaccaucaaaaugaaccccagcaaugggcacucccaaauuacucagguagaacuggucauaaugugcaccuagccccugccguugcccccacuuuuccgggugagcaacuucuuuucuuuagauccacuaugcccggauguagcggguaucccaacaugaaucuggauugccuacucccccaggaaugggugcagcacuucuaccaagaagcagcuccagcacaaucugauguggcucugcugagauuugugaauccagacacagguaggguccuguuugagugcaagcuccauaaaucgggcuaugucacaguggcucacacuggcccgcaugauuugguuaucccccccaaugguuacuuuagauuugauuccugggucaaccaguucuacacacuugcccccaugggaaauggagcggggcguagacguuaa

SEQ ID NO: 8267 - RNA, 1614 nt, Artificial Sequence
  VP1__Norovirus_and/or_Norovirus-like__AB684705
augaagauggcgucgagugacgccaacccaucugauggguccgcagccaaccucgucccagaggucaacaaugaggucauggcuuuggagccuguuguuggugcugccauugcagcgccuguggcaggccaacaaaauauaauugaccccuggauuagaaauaauuuuguacaagccccugguggagaguucacagugucccccagaaacgcuccaggugagauacuauggagcgcgcccuugagcccugauuugaaccccuaucuuucccaccuguccagaauguacaaugguuaugcaggugguuuugaggugcaaguaauccucgcggggaacgcguucaccgcugggaaagucauauuugcagcaguuccaccaaauuuuccaacugaaggucuaagccccagccagguuacuauguucccccauauaauuguagauguuaggcaauuggagccuguguugaucccccuaccugauguuaggaauaauuucuaucauuauaaucaaacacaugauucuacccuuaaauugauagcaauguuguauacaccacucagagcuaauaaugcuggagaugaugucuuuacagucucuugucgaguccucacgagaccaucccccgauuuugauuucauauuccuggugccacccacaguugaaucaagaacuaaaccauuuacugucccaaucuuaacuguugaggagauguccaauucaagguuccccaucccuuuggaaaagcuguauacggguccuagcagugcuuuuguuguccaaccacaaaauggcagaugcacgacugauggcgugcucuugggcacuacucaacugucagcugucaauaucuguaauuucaggggggaugucacccguguugggaucagccaugauuauacaaugaacuuggugucccaaaauuggaacaauuaugauccaacagaagaaauuccagcaccccuggggacacccgacuuuguaggaaagauacaaggcuugcucacccaaaccacaagagcggacagcucgacccgcgcccacaaagcuacacugagcacugggaguguccacuucacuccaaagcuggguaguguucaauucaccaccgauacgaauaaugauuuccagacuggccaaaacacaaaauuuaccccaguuggugucauccaagacagcgaucaccaucagaaugaaccccaacaauggguacucccaaauuacucaggcucaucuggucacaaugugcaucuggccccugcaguugcccccacuuucccaggugagcagcuucuuuucuucagguccacuaugccuggguguagcggguaccccaacaugaauuuggacugccugcucccccaggaguggguacugcacuuuuaccaggaagcagccccagcacaauccgauguggccuugcugagauuugugaauccggacacagguaggguuuuguuugagugcaaacuccauaagucaggcuauaucacaguggcucauacuggcccguaugauuugguuaucccccccaaugguuauuucagauuugauucuuggguuaaucaauucuacacgcucgcccccaugggaaauggaacggggcgcaggcguuaa

SEQ ID NO: 8268 - RNA, 1614 nt, Artificial Sequence
  VP1__Norovirus_and/or_Norovirus-like__KF806523
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugucacccacaguugagucaagaucaaaaccauucaccgucccaauucuaacuguugaggaaaugaccaauucaagguuccccauucccuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuuacaggcaccuccgaauacgcaaugaauuuggcuucucaaaauuggaauaauuaugacccaacagaagaaaucccagccccucugggagccccagauuuugugggaaagauccgagguaugcucacucaaaccacaaggagggacgguucgacccgcggccacagggcuacauugagcacugggagcgcccacuucacuccaaagcugggcaacauucgguuuuccacugauacaaacaaugauuuugaagcuggccaaaacacgaaauucaccccagucggugucuuccaggaaggcgacaaccaccaaaaugaaccccaacaaugggugcucccaaauuauucaggugcaacugcccacaauguacaccuugccccugccguggcccccgcuuuuccgggugagcaacugcucuucuucagguccaccaugcccggauguggcggguaucccaacaugaauuuggauugucuacucccacaggaaugggugcagcacuucuaucaagaggcagccccagcacaaucugacguggcucugcuaagauuugugaauccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacguuaa

SEQ ID NO: 8269 - RNA, 1614 nt, Artificial Sequence
  VP1__Norovirus_and/or_Norovirus-like__AY532129
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagcccaugguggagaguuuacaguauccccuagaaacgcuccgggugagauacuauggagcgcgcccuuaggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguuuccccauauaauaguagauguuaggcaauuggaaccuguguugauucccuuaccugauguuaggaauaauuucuaucauuacaaucagucaaaugacucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuucguuguccaaccacaaaauggcaggugcacgacugauggcgugcucuuaggcacuacccagcugucugcugucaacaucugcaccuucagaggggaugucacccacauugcaggcagucaugauuauacaaugaauuuggcuucucaaaauuggaacagcuacgacccaacagaagagaucccagccccccugggaacuccagauuucgugggaaagauccaaggcaugcucacccaaaccacaagagaggauggcucgacccgcgcccacaaagcuacagugagcacugggaguguccacuuuacuccaaagcugggcaguguccaauacaccacugacacaaacaaugauuuucaaacuggccaaaacacgaaauucaccccagucggugucauccaggacgguaauaaccaucaaaaugaaccccaacaaugggugcucccaaauuacucaggcagaacaggucauaauguacaccuagcuccugccguugcccccacuuuuccgggugagcaacuucuuuucuuuagguccacuaugcccggauguagcggguaucccaacaugaaucuggauugccuacucccccaggaaugggugcagcacuucuaccaagaagcagcuccagcacaaucugauguggcucugcugagauuugugaauccagauacagguaggguucuguuugagugcaagcuccauaaaucaggcuaugucacaguggcucacacuggcccgcaugauuugguuaucccccccaaugguuauuuuagauuugauuccugggucaaccaguucuacacacuugcccccaugggaaauggagcggggcguagacguuaa

SEQ ID NO: 8270 - RNA, 1614 nt, Artificial Sequence
  VP1__Norovirus_and/or_Norovirus-like__AY532124
augaagauggcgucgaaugacgccaacccaucugauggguccacagccaaccucgucccagaggucaacaaugagguuauggcuuuggagcccguuguuggugccgcuauugcggcgccuguagcgggccaacaaaauguaauugaccccuggauuagaaauaauuuuguacaagccccugguggagaguuuacaguauccccuagaaacgcuccgggugagauacuauggagcgcgcccuugggcccugauuugaacccuuaccuuucucauuuggccagaauguacaaugguuaugcagguggcuuugaagugcagguaauccucgcgaggaacgcguucaccgccgggaaagucauauuugcagcagucccaccaaauuuuccaacugaaggcuugagccccagccagguuacuauguucccccauauaauaguagauguuaggcaacuggaaccuguguugauccccuuaccugaugucaggaacaauuucuaucauuacaaucaaucaaaugauuccaccauuaaauugauagcaaugcuguauacaccacuuagggcuaauaaugcuggggaugaugucuucacagucucuugucgaguccucacaaggccaucccccgauuuugauuuuauauuuuugguaccacccacaguugaaucaagaacuaaaccguucaccgucccaauccuaacuguugaggaaauguccaauucaagguuccccaucccuuuggaaaaguuguacacgggucccagcagugcuuuuguuguccaaccacaaaauggcaggugcacgacugauggugugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugagcacugggaguguccacuuuacuccaaagcugggcaguguccaauacaccacugacacaaacaaugauuuucaaacuggccaaaacacgaaauucaccccagucggcgucauccaggacgguaauaaccaucaaaaugaaccccaacaaugggugcucccaaauuacucagguagaacuggucauaauguacaccuagcuccugccguugcccccacuuuuccgggugagcaacuucuuuucuuuagguccacuaugcccggguguagcggguaucccaacaugaaucuggauugccuacucccccaagaaugggugcagcacuucuaccaagaagcagcuccagcacaaucugauguggcucugcugagauuugugaauccagauacagguaggguucuauuugagugcaagcuucauaaaucaggcuaugucacaguggcccacacuggcccgcaugauuugguuaucccccccaaugguuacuucagauuugauuccugggucaaccaguucuacacacucgcccccaugggaaauggagcggggcguagacguuaa

SEQ ID NO: 8271 - RNA, 1614 nt, Artificial Sequence
  VP1__Norovirus_and/or_Norovirus-like__KX514309
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuggguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggaugucacccacccugggggcucuaaaauuuacacaaugaauuuggccucuccaaauuggaacaauuaugacccaacagaagagauuccagccccucugggaacuccagauuuuguaggaaagauccaugguaugcucacccaaaccacaaagggagaagguucgacccggggccauagagcaacaguuuauguugggggugccaauuucacuccaaagcugggcaaaguucaauuugaaacugauacaggcgaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccuccuaauggcuacuuuagguuugauuccuggguuaaucaauucuacacacuugcccccaugggaaauggaacggggcguaagcguuaa

SEQ ID NO: 8272 - RNA, 1614 nt, Artificial Sequence
  VP1__Norovirus_and/or_Norovirus-like__KX514308
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguuuaccgugucuccuagaaacgcuccaggugaaauacuauggagcgcgcccuuagguccugaccugaaucccuaccuaucucauuuggccagaauguauaaugguuaugcaggugguuuugaagugcagguaauucucgcggggaaugcguuuaccgcgggaaaaaucauauuugcagcagucccuccaaauuuuccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugacgucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggauaaauuauucacaggacccagcagugccaauguuguucaaccacaaaauggcaggugcacgauugauggcgagcucuuaggcaccacccaacugucuucuguuaacauuugcaccuucagaggggacguuacucacauugggucaacucgccauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggagugccgauuucacuccaaagcugggcaaaguucaauuugaaacugauacagaagaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8273 - RNA, 1614 nt, Artificial Sequence
  VP1__Norovirus_and/or_Norovirus-like__KX514283
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuacaaucagucaaaggauuccaccauuaaauugauagcaaugcuguauacaccacuuagggccaauaaugcuggggaugaugucuucacgguuucuugccgaguccucacgaggccauccccugauuuugacuucauauuccuggugccaccuacaguugagucaaggucuaagcccuuuucugucccagucuuaacuguugaagaaaugaccaauucaagauuccccguuacuuuagauaaauuguucacaggucccagcaguaccauuguuguucaaccacaaaauggcagaugcaugauugauggcgugcucuuaggcaccacccaacuguccccugucaacaucugcaccuucagaggggacgucacccacccuagggacucuacaauuuacacaaugaauuuggccucuccaaauuggaacaauuaugacccaacagaagagauuccagccccucugggaacuccagauuuuacgggaaagauccaagguaugcucacucaaaccacaaagggagaagguucgacccggggccauagagcaacaguuuauguugggagugccgaauucacuccaaagcugggcaaaguucgauuugaaacugauacagaagaugaucuuguaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8274 - RNA, 1614 nt, Artificial Sequence
  VP1__Norovirus_and/or_Norovirus-like__KX514194
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguaucuccuagaaacgcuccaggugaaauacuauggagcgcgccuuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacagggaaauggcucgacccggggccauagagcaacaguuuauguugggagugccgaauucacuccaaagcugggcaaaguucaauuuaaaacugaaacagaccaugaucuugcaauucgccaaaacacaaaauucaccccagucggugucauccaggaaagugaucaccaccgagaugaaccccaacaauggaggcucccaaauuauucaggugcaaauaccuuuaauguacaccuagccccugcuguagcccccaauuuccccggugaacaacuucucuucuucagguccacucugcccgggugcggugggcaucccaacauggacuuggacugccugcucccccaggagugggugcagcacuucuaccaagaggcagccccagcacaaucugauguggcucuauugagauuugugaauccagacacgaguaggguccuguuugaauguaaacuucauaaaucaggcuacgucacaguggcucacaccggccaauaugauuugguccuccccucuaaugguuauuuuagguuugauuccugggucaaucaauucuacacacuugcccccaugggaaauggaacggggcguaggcguuaa

SEQ ID NO: 8275 - RNA, 1614 nt, Artificial Sequence
  VP1__Norovirus_and/or_Norovirus-like__KY424340
augaagauggcgucgagugacgccaacccaucugauggguccgcagccaaccucgucccagaggucaacaaugagguuauggcucuggagcccguuguuggugccgcuauugcggcaccuguagcgggccaacaaaauauaauugaccccuggauuagaaauaauuuuguacaagccccugguggagaguucacagugucuccuagaaacgcuccaggugagauacuauggagcgcgcccuugggcccugauuugaaccccuaucuuucucauuuguccagaauguacaaugguuaugcaggugguuuugaagugcaaguaauccucgcggggaacgcguucaccgccgggaaaguuauauuugcagcaguuccaccaaacuuuccaacugaaggcuuaagccccagccagguuacuauguucccccauauaauuguagauguuaggcaauuggaaccuguguugaucccccuaccugauguuaggaauaauuucuaucauuacaaccaaucacaugauucuacccuuaaguugauagcaauguuguacacaccacucagggcuaauaaugccggggaugaugucuucacagucucuugucgaguucucacuaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacggguccuagcagugcuuuuguuguccaaccacaaaauggcagaugcacgacugauggcgugcucuuaggcacuacccagcugucagcugucaacaucuguaacuuuaggggggaugucacccauauugugggcagccaugauuauacaaugaaccuggcuucccaaaauuggagcaauuaugacccaacagaagaaaucccagcuccccugggaacaccagauuuuguggggaagauccaaggccugcucacccagaccacaagagcggauggcucgacccgugcccacaaagcuacagugagcacugggaguguccacuucacuccaaagcuggguaguguucaauucaccacugacacaaacaaugauuuccaaacuggccaaaauacgaaauucaccccaguuggcgucauccaagacggugaucaccaucagaaugagccccaacaauggguacucccaaauuacucagguagaacuggucauaaugugcaccuggccccugccguugcccccacuuuuccgggugagcaacuccuuuucuuuagauccacuaugcccggauguagcggguaucccaacaugaauuuggauugccuacucccccaggaaugggugcugcacuucuaccaggaagcagcuccagcacaauccgauguggcucugcugagguuugugaauccagacacagguaggguucuguuugagugcaagcuccauaaaucaggcuauaucacaguggcucacaccggcccguaugacuugguuaucccccccaaugguuauuucagauuugauuccugggucaaucaguucuacacacuugcccccaugggaaauggaacggggcgcaggcguuaa

SEQ ID NO: 8276 - RNA, 1614 nt, Artificial Sequence
  VP1__Norovirus_and/or_Norovirus-like__LC016606
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuucaggcacucauacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucgccacugauacaaacaaugauuuugaaacuggccaaaacacaagguucaccccagucggugucauccaggaugguagugcccacagaaaugaaccccaacaauggguacucccagauuacucagguaaaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacguuaa

SEQ ID NO: 8277 - RNA, 1614 nt, Artificial Sequence
  VP1__Norovirus_and/or_Norovirus-like__FJ537136
augaagauggcgucgagugacgccaacccaucugauggguccgcagccaaccucgucccagaggucaacaaugagguuauggcucuggagcccguuguuggugcugcuauugcagcaccuguagcgggccaacaaaauauaauugaccccuggauuagaaacaauuuuguacaagccccugguggugaguuuacaguguccccuagaaacgcuccaggugagauacuauggagcgcgcccuugggcccugauuugaaccccuaucuuucucaucuguccagaauguacaaugguuaugcaggugguuuugaagugcaaguaauucucgcggggaacgcguucaccgccgggaaaguuauauuugcggcaguuccaccaaacuuuccaacugaaggcuuaagccccagccaggucacuauguucccccauauaauuguagauguuaggcaauuggaaccuguguugaucccccuaccugauguuaggaauaauuucuaucauuauaaucaaucacaugauucuacccuuaagcugauagcaauguuguauacaccacucagagcuaauaaugccggggaugaugucuucacagucucuugucgaguucucacgaggccaucccccgauuuugauuuuauauuccuugugccacccacaguugaaucaagaaccaaaccauucacugucccaaucuuaacuguugaggaaaugucuaauucaagauuccccauuccuuuggaaaaguuauauacggguccuagcagugcuuuuguuguccaaccacaaaauggcagauguacgacugauggcgugcucuuaggcacuacccagcugucagcugucaauaucuguaacuucaggggggaugucacccacauugugggcagccaugauuauacaaugaaucugguaucccaaaauuggagcaauuaugacccaacagaagaaaucccagccccccugggaacaccagauuucgugggaaagauccaaggccugcucacccagaccacaagagcggauggcucgacccgugcccacaaggcuacagugagcacugggagcguccacuucacuccaaagcuggguaguguucaauucaccacugacacaaacaaugauuuccaaacuggccaaaacacgaaauucacaccaguuggcgucauccaagacggugaucaccaccagaaugaaccccaacaaugggugcucccaaauuacucagguagaacuggucauaaugugcaccuggccccugccguugcccccacuuuuccgggugagcaacuccuuuucuucagguccacuaugcccggauguagcggguaccccaacaugaacuuggauugucuacucccccaggaaugggugcugcacuucuaccaggaagcagcuccagcacaauccgauguggcucugcugagauuugugaauccagacacagguaggguccuguuugagugcaagcuccauaagucaggcuauaucacaguggcucacaccggcccguaugauuugguuaucccccccaaugguuauuuuagauuugauuccugggucaaccaguucuacacacuugcccccaugggaaauggaacggggcgcaggcguuaa

SEQ ID NO: 8278 - RNA, 1614 nt, Artificial Sequence
  VP1__Norovirus_and/or_Norovirus-like__AY532117
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacugggccccuggggagaguuuacaguguccccuagaaacgcuccgggugagauacuguggagcgcgcccuugggcccugauuugaacccuuaccuuucucauuuggccagaauguacaaugguuacgcagguggcuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaacaauuucuaucauuacaaucagucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaaugucuaauucaagauuccccauuccuuuggaaaaguuauacacgggucccagcagugcuuuuguuguccaaccacaaaauggcaggugcacgacugauggcgugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcgugcucacccaaacuacaagagaggauggcucgacccgcgcccacaaagcuacagugagcacugggaguguccacuuuacuccaaagcugggcaguguucaauacaccacugacacaagcaaugauuuucaaacuggccaaaacacgaaauucaccccagucggcgucauccaggacgguaauaaccaucaaaaugaaccccaacaauggguacucccaaauuacucaggcagaacuggucauaaugugcaccuagcuccugccguugcccccacuuuuccgggugagcaacuucuuuucuuuagguccacuaugcccggauguagcggguaucccaacaugaaucuggauugccuacucccccaggaaugggugcagcacuucuaccaagaagcagcuccagcgcaaucugauguggcucugcugagauuugugaauccagauacagguaggguucuguuugaguguaagcuccauaaaucagguuaugucacaguggcucacacuggcccguaugauuugguuaucccccccaaugguuacuuuagauuugauuccugggucaaccaguucuacacacuugcccccaugggaaauggagcggggcguagacguuaa

SEQ ID NO: 8279 - RNA, 1614 nt, Artificial Sequence
  VP1__Norovirus_and/or_Norovirus-like__KX514279
augaagauggcgucgaaugacgccaacccaucugauggguccgcagccaaccucgucccagaggucaauaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauugggucaacucaccauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggagugccgauuucacuccaaagcugggcaaaguucaauuugaaacugauacagaagaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8280 - RNA, 1614 nt, Artificial Sequence
  VP1__Norovirus_and/or_Norovirus-like__LC016602
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuucaggcacuaguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucgacacugauacaaacaaugaucuugaaacuggccaaaacacaagguucaccccagucggugucauccaggaugguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacguuaa

SEQ ID NO: 8281 - RNA, 1614 nt, Artificial Sequence
  VP1__Norovirus_and/or_Norovirus-like__AF145896
augaagauggcgucgagugacgccaacccaucugauggguccgcagccaaccucgucccagaggucaacaaugagguuauggcucuggagcccguuguuggugccgcuauugcggcaccuguagcgggccaacaaaauauaauugaccccuggauuagaaauaauuuuguacaagccccugguggagaguuuacaguguccccuagaaacgcuccaggugagauacuauggagcgcgcccuugggcccugauuugaaucccuaucuuucucacuuguccagaauguauaaugguuaugcaggugguuuugaagugcaagugauccuugcggggaacgcguucaccgccgggaaaguuauauuugcagcaguuccaccaaacuuuccaacugaaggcuuaagccccagccagguuacuauguucccccauauaauuguagauguuagacaacuggaaccuguguugauuccccuaccugaugucaggaauaauuucuaucauuacaaucaaucacaugauucuacccuuaaauugauagcaaugcuguacacaccacuuagggcuaauaaugccggggaugaugucuuuacagucucuugucgaguucucacgagaccaucccccgauuuugauuuuauauucuuggugccacccacaguugaaucaagaacuaaaccauucaccgucccaauuuuaaccguugaggaaauguccaauucaagauuccccauuccuuuggaaaagcuguauacgggucccagcagugcuuuuguuguacaaccacaaaauggcagaugcacgacugacggcgugcucuuaggcacuacccagcugucagcugucaacaucugcaacuuuaggggggaugucacccauauugugggcagccaugauuauacaaugaacuuggcuucccaaaauuggagcaauuaugacccaacagaagaaaucccagccccccugggaacaccagauuuuguggggaagauccaaggucugcucacccaaaccacaagagcagauggcucgacccgugcccacaaagcuacagugagcacugggaguguccacuucacuccaaagcuggguaguguucaauucaccacugacacaaacaaugauuuccaaacuggccaaaacacgaaauucaccccaguuggugucauccaagacggugaccaccaccagaaugagccccaacaauggguacucccgaauuauucagguagaacuggucauaaugugcaccuggccccugccguugcccccacuuuuccgggugagcaacuccuuuucuuuagauccacuaugcccggguguagcggguaucccaacaugaacuuggacugccuacucccccaggaaugggugcugcacuucuaccaggaagcagcuccagcacaaucugauguggcucugcugagauuugugaauccagacacagguaggguucuguuugagugcaagcuccauaagucaggcuacaucacaguggcccacaccggcccguuugacuugguuauccccccuaaugguuauuuuagauuugauucuugggucaaccaguucuacacacuugcccccaugggaaaugggacggggcgcaggcguuaa

SEQ ID NO: 8282 - RNA, 1614 nt, Artificial Sequence
  VP1__Norovirus_and/or_Norovirus-like__AB684704
augaagauggcgucgagugacgccaacccaucugauggguccgcagccaaccucgucccagaggucaacaaugaggucauggcuuuggagccuguuguuggugcugccauugcagcgccuguggcaggccaacaaaauauaauugaccccuggauuagaaauaauuuuguacaagccccugguggagaguucacaguguccccuagaaacgcuccaggugagauacuauggagcgcgcccuugagcccugauuugaaccccuaucuuucccaccuguccagaauguacaaugguuaugcaggugguuuugaggugcaaguaauccucgcggggaacgcguucaccgcugggaaagucauauuugcagcaguuccaccaaauuuuccaacugaaggucuaagccccagccagguuaccauguucccccauauaauuguagauguuaggcaauuggaaccuguguugaucccccuaccugauguuaggaauaauuucuaucauuauaaucaagcacaugauucuacccuuaaauugauagcaauguuguauacaccacucagagcuaauaaugcuggagaugaugucuuuacagucucuugucgaguccucacgagaccaucccccgauuuugauuucauauuccuggugccacccacaguugaaucaagaacuaaaccauuuacugucccaaucuuaacuguugaggagauguccaauucaaaguuccccaucccuuuggaaaagcuguauacggguccuagcagugcuuuuguuguccaaccacaaaauggcagaugcacgacugauggcgugcucuugggcacuacucaacugucagcugucaauaucuguaauuucaggggggaugucacccguguugggaccagucaugauuauacaaugaacuuggugucccaaaauuggaacaauuaugauccaacagaagaaauuccagcaccccuggggacaccagacuuuguaggaaagauccaaggcuugcucacccaaaccacaagagcggacggcucgacccgcgcccacaaagcuacagugagcacugggaguguccacuuuacuccaaagcuggguaguguucaauucaccaccgauacgaacaaugauuucgagacuggccaaaacacaaaauuuaccccaguuggugucauccaagacggugaucaccaucagaaugaaccccaacaauggguacucccaaguuacucaggcucaucuggucacaaugugcaucuggccccugcaguugcccccacuuucccaggugagcagcuucuuuucuucagguccacuaugccuggguguagcggguaccccaacaugaauuuggauugccugcucccccaggaguggguacugcacuuuuaccaggaagcagccccagcacaauccgauguggccuugcugagauuugugaauccagacacagguaggguuuuguuugagugcaaacuccauaagucaggcuauaucacaguggcucauacuggcccguaugauuugguuaucccccccaaugguuauuucagauuugauucuuggguuaaucaauucuacacgcucgcccccaugggaaauggaacggggcgcaggcguuaa

SEQ ID NO: 8283 - RNA, 1614 nt, Artificial Sequence
  VP1__Norovirus_and/or_Norovirus-like__JX401279
augaagauggcgucgagugacgccaacccaucugauggguccgcagccaaccucgucccagaggucaacaaugagguuauggcuuuggagccuguuguuggugcugccauugcagcaccuguagcaggccagcaaaauauaauugaccccuggauuagaaauaauuuuguacaagccccugguggagaauucacaguguccccuagaaacgcuccaggugaaauacuguggagcgcgcccuuaggcccugauuugaaccccuaucucucucaccuguccagaauguacaaugguuaugcaggugguuuugaagugcaaguaauccucgcggggaacgcguucaccgccgggaaagucauauuugcagcaguuccaccaaauuuuccaacugaaggccuaagccccagucagguuacuauguucccccauauaauuguggauguuaggcaauuggaaccuguauugaucccccuaccugauguuaggaauaauuucuaucauuauaaucaagcacaugauuccacccucaaauugauagcaauguuguacacaccacucagagcuaacaaugccggggaugauguuuuuacagucucuugucgaguccucacgagaccauccccugauuuugauuuuauauuccuggugccacccacaguugaaucaagaacuaaaccauuuacugucccaaucuuaacuguugaggaaauguccaauucaagauuccccaucccuuuggaaaagcuguacacggguccuagcagugcuuuuguuguccaaccacaaaauggcagaugcacgacugauggcgugcucuuaggcacuacucagcugucagcugucaacaucugcaacuucaggggggaugucacccguguugggaccagccaugauuauacaaugaauuuggugucccaaaauuggaauaauuaugacccaacagaagaaaucccagcuccccuggggacaccagacuuuguaggaaagauccaagguuugcucacccaaacuacaagagcggacggcucgacccgcgcccacaaggccacagugagcaccgggaguguccacuucacuccaaagcuggguaguguucaauucaccaccgauacggacaaugauuuccaaacuggccaaaacacaaaauuuaccccaguuggugucauccaagacggugaccaccaucagaaugaaccccaacaauggguacucccaaauuacucaggcacaucuggucacaaugugcaucuggccccugccguugcccccgccuucccgggugagcagcuucuuuucuuuagguccacuaugcccggguguagcggguaccccaacaugaauuuggauugccuacucccccaggagugggugcugcacuuuuaccaggaggcagccccagcacaauccgauguggcccugcugagguuugugaacccagacacagguaggguucuguuugagugcaaacuccauaagucaggcuauaucacaguggcucauacuggcccauaugauuugguuaucccccccaaugguuacuucagauuugauucuugggucaaccaguucuacacacucgcccccaugggaaauggaacggggcgcaggcguuaa

SEQ ID NO: 8284 - RNA, 1614 nt, Artificial Sequence
  VP1__Norovirus_and/or_Norovirus-like__GQ389627
augaagauggcuucuaaugaugccaacccuagugauggauccacagcaaaccuuguuccagagguuaacaaugagguuauggcucuugagccuguuguuggugcugccauugcugcaccuguugcuggacaacagaauguuauugacccuuggauuaggaacaacuuugugcaagcaccugguggagaguuuacagugucuccuaggaaugcuccaggugagauacuuuggagugcuccucuuggaccugauuugaauccuuaucuuucucauuuggcuaggauguacaaugguuaugcugguggcuuugaaguccaagugauucuugcugguaaugccuucacugcuggcaagauuauauuugcugcuguuccaccuaacuuuccuacugaaggcuugucaccuagccaaguuacuauguucccucacauaauuguggauguuagacaauuggagccuguguugauuccauuaccugauguuaggaauaacuucuaucauuauaaccagagcaaugauagcacuaucaaauugauugcaaugcucuauacaccucuuagggcuaacaaugcuggagaugauguauucacaguuucuuguaggguccuuacuaggccuucaccagacuuugauuucauauucuuggugccaccuacaguugagucaaggacuaaaccauucacuguaccaauucuuacuguugaggagauguccaacucaagguuuccaauaccuuuggagaaguuguacacaggucccucuagugccuuuguuguacaaccucagaaugguagguguaccacugauggagugcucuuaggaacuacccaacuuagugcugucaacauuuguaccuuuagaggagaugucacccauauugcugguucccaugacuacacuaugaacuuggccucucagaauuggagcaauuaugauccaacagaagagauuccagcuccucuugguacuccagacuuugugggaaagauccaaggcaugcucacccagaccacaagagaagauggauccacuagagcccacaaggcuacaguguccacugguaguguucacuucacucccaagcuugguaguguucaguauaccacagacacaaacaaugauuuccaaacuggacagaacacuaaauucacuccaguaggagugauccaagauggaaauaaccaucagaaugagccacaacaaugggugcucccaaauuauagugguagaacuggacauaaugugcaucuugcaccugcuguugcacccacuuucccaggugaacaauuauuguucuuuagguccacuaugccaggauguagugguuaucccaacaugaaucuugauugccuucucccucaagaaugggugcaacacuuuugccaagaagcugcaccagcacaaagugauguggcacugcuuagguuugugaauccagauacagguagggucuuguuugagugcaagcuccacaagaguggcuauguuacaguggcacauacuggcccacaugauuugguuaucccucccaaugguuacuuuagguuugacucaugggucaaucaguucuacacacuugcaccaaugggaaauggugcugguagaaggagauaa

SEQ ID NO: 8285 - RNA, 1614 nt, Artificial Sequence
  VP1__Norovirus_and/or_Norovirus-like__AF425763
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccucguggagaguuuacaguauccccuagaaacgcuccgggugagauacuauggagcgcgcccuugggcccugauuugaaccccuaccuuucucauuuggccagaauguacaauggcuaugcaggugguuuugaagugcagguaauucucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugauguuaggaauaacuucuaucauuauaaucaaucaaaugauucuaccauuaaauugauagcaaugccguauacaccacuuagggcuaauaaugcuggggaugaugucuuuacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcuccuaggcacuacccagcugucugcugucaacaucugcaccuucagaggggaugucacccacauugcaggcagucaugauuauacaaugaauuuggcuucacaaaauuggaacaauuaugacccaacagaagaaaucccagccccucugggaacuccagauuucgugggaaagauccaaggcaugcucacccaaaccacaagagaggauggcucgacccgcgcccacaaagcuacagugagcacugggaguguccacuuuacuccaaggcugggcaguguucaauacaccacugacacaaauaaugauuuucaaacuggccaaaacacgaaauucaccccagucggcgucauccaggauggcaauaaccaucaaaaugaaccccaacaauggguacucccaaauuacucagguagaacuggucacaaugugcaccuagcuccugccguugcccccacuuuuccgggugagcaacuucuuuucuuuagauccacuaugcccggauguagcggguaucccaacaugaaucuggauugccuacucccccaggaaugggugcagcacuucuaccaagaagcagcuccagcacaaucugauguggcucugcugagauuugugaauccagauacagguaggguucuguuugagugcaagcuccauaaaucaggcuaugucacaguggcucacacuggcccgcaugacuugguuaucccccccaaugguuacuuuagauuugauuccugggucaaccaguucuacacacuugcccccaugggaaauggagcggggcguagacguuaa

SEQ ID NO: 8286 - RNA, 1614 nt, Artificial Sequence
  VP1__Norovirus_and/or_Norovirus-like__AY532127
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaacaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugagggcuugagccccagccagguuacuauguucccccauauaauaguagauguuaggcaauuggaaccuguguugauucccuuaccugaugguaggaacaauuucuaccauuacaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcuccuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcacgcucacccaaaccacaagagaggauggcucgacccgcgcccacaaagcuacagugagcacugggaguguccacuuuacuccaaagcugggcagugcucaauacaccacugacacaaacaaugauuuucaaacuggccaaaacacgaaauucaccccagucggugucauccaggacgguaauaaccaucaaaaugaaccccaacaauggguacucccaaauuacucagguaggacuggucauaaugugcaccuagcuccugccguugcccccacuuuuccgggugagcaacuucuuuucuuuagguccacuaugcccggauguagcggguaucccaacaugaaucuggauugccuacucccccaggaaugggugcagcacuucuaccaagaagcagcuccagcacaaucugauguggcucugcugagauuugugaauccagacacagguaggguucuguuugaguguaagcuccauaaaucaggcuaugucacaguggcucacacuggcccgcaugauuugguuaucccccccaaugguuacuuuagauuugauuccugggucaaccaguucuacacacuugcccccaugggaaauggagcggggcguagacguuaa

SEQ ID NO: 8287 - RNA, 1614 nt, Artificial Sequence
  VP1__Norovirus_and/or_Norovirus-like__AY532118
augaagauggcgucgaaugacgccaacccaucugauggguccacagccaaccucgucccagaggucaacaaugagguuauggcuuuggagcccguuguuggugccgcuauugcggcaccuguagcgggccaacaaaauauaauugaccccuggauuagaaauaauuuuguacaagccccugguggagaguuuacaguguccccuagaaaugcuccgggugagauacuauggagcgcgcccuugggcccugaucugaaccccuaccuuucccauuuggccagaauguacaaugguuaugcaggugguuuugaagugcagguaauccucgcggggaacgcguucaccgccgggaaaaucauauuugcagcagucccaccaaauuuuccaacugaaggcuugggccccagccaggucacuauguucccccauauaauaguagauguuaggcaauuggaaccugugcugaucccuuuaccugauguuaggaauaauuucuaucauuacaaucaaucaaaugauucuaccauuaaauugauagcaaugcuguauacaccacuuagggcuaauaaugcuggggaugaugucuucacagucucuugucgaguccucacgaggccaucccccgacuuugacuucauauucuuggugccacccacaguugaaucaagaacuaaaccauucaccgucccaaucuuaacuguugaggaaauguccaauucaagauuccccguuccuuuggaaaaguuguacacgggucccagcagugcuuucguuguccaaccacaaaacggcagaugcacgacugauggcgugcucuuaggcaccacccagcugucugcagucaacaucugcaccuucagaggggaugucacccacauugcaggcagucgugauuacacaaugaauuuggcuucucaaaauuggaacaauuaugacccaacagaagaaaucccagccccucugggaaccccagauuucgugggaaagauucaaggcgugcucacccaaaccacaagagaggacggcucgacccgcgcccacaaagcuacagugagcacugggaguguccacuuuacuccaaagcugggcaguguucaauacacuacugacacagacaaugauuuucaaacuggccaaaacacgaaauucaccccagucggcgucauccaggacgguaauaaccaucaaaaugaaccccaacaaugggugcucccaaacuacucagguagaccuggucauaaugugcacuuagccccugccguugcccccacuuuucugggugagcaacuucuuuucuuuagguccacuaugcccggauguagcggguaucccaauaugaaucuggauugccuacucccccaggaaugggugcagcacuucuaccaagaagcagcuccagcacaaucugauguggcucugcugagauuugugaauccagacacagguaggguucuguuugagugcaaacuccauaagucaggcuaugucacaguggcucacacuggcccgcaugauuugguuaucccccccaaugguuauuuuagauuugauucuugggucaaucaguuuuacacgcuugcccccaugggaaauggagcggggcguagacguuaa

SEQ ID NO: 8288 - RNA, 1614 nt, Artificial Sequence
  VP1__Norovirus_and/or_Norovirus-like__KX514326
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauugggucaacuaaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggggugccaauuucacuccaaagcugggcaaaguucaauuugaaacugauacagucgaugaucuugaaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8289 - RNA, 1614 nt, Artificial Sequence
  VP1__Norovirus_and/or_Norovirus-like__KX514264
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccguaaauuuggaaagauuauucacgggacccaguagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucaauuucaaacugaaacagaagaugaucuuguaauucgccaaaacacaaaauucaccccagucggugucauccaggaaagugaucaccaccgagaugaaccccaacaauggaggcucccaaauuauucaggugcaaauaccuuuaauguacaccuagccccugcuguagcccccaauuuccccggugaacagcuucuuuucuucagguccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8290 - RNA, 1614 nt, Artificial Sequence
  VP1__Norovirus_and/or_Norovirus-like__KX514171
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggccagaauguauaaugguuaugcaggugguuuugaagugcaggugauccuugcggggaacgcguucaccgccggaaagauuauauuugcagcagucccaccaacuuucccaacugagggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacggucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggacaacucaacauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucgauuugaaacugauacagaagaugaucuuguaauucgccaaaacacaaaauucaccccagucggugucauccagucaagugaacaccaccgagaugaaccccaacaauggaggcucccaaauuauucaggugcaaacaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauucuugggucaaucaauucuacacacuugcccccaugggaaauggaacggggcguaggcguuaa

SEQ ID NO: 8291 - RNA, 1614 nt, Artificial Sequence
  VP1__Norovirus_and/or_Norovirus-like__KX514170
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaagauuauauuugcagcagucccaccaacuuucccaacugagggcuugagucccagucaggucaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggcuaacaauccuggggaugaugucuucacagucuccugucgaguccuuacgaggccauccccugauuuugacuuuauauuucuggugccaccuacaguugagucaagaacuaaaccauuuucugucccaauccuaacuguuggagaaaugacuaauucaagauuccccguaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggacaacucaacauuggauaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucgauuugaaacugauacagaagaugaucuuguaauucgccaaaacacaaaauucaccccagucggugucauccagucaagugaacaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8292 - RNA, 1614 nt, Artificial Sequence
  VP1__Norovirus_and/or_Norovirus-like__KF806533
augaagauggcgucgaaugacgccagcccaucugauggguccgcagccaaccucguuccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccacauaguaguagauguuagacaacuggaaccuguguugauccccuuacccgaugucaggaauaauuucuaccacuauaaucaaucaaaagaccccaccaucaaauugauagcaaugcuguacacaccacuuagggccaauaaugcuggggaagaugucuucacagucucuugccgaguccucacgagaccaucccccgauuuugauuucauauucuuggugccacccacaguugagucaagaucaaaaccauucaccgucccaauuuuaacuguugaggaaaugaccaauucaagguuccccauuccuuuggaaaagcuguucacgggucccagcagcgccuuuguuguccaaccacaaaauggcaggugcacgacugauggcgugcucuuaggcaccacccaacugucuccugucaacaucugcaccuucagaggggaucucacccacuuugcaggcacccacgaauacgcaaugaauuuggcuucucaaaauuggacuaauuaugacccaacagaagaaaucccagccccccugggagccccagauuucgugggaaagauccgaggugugcucacucaaaccacaaggggggacggcucgacccgcggccacagggcuacauugagcacugggagcgcccacuucacuccaaagcugggcagcguucgguuuuccacugauacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggcccccgcuuuuccgggugagcaacugcuuuucuucagguccaccaugcccggaugcagcggguaucccaacaugaauuuggauugucuacuuccacaggaaugggugcagcacuucuaucaagaggcagccccagcacaaucugauguggcucugcuaagauuugugaacccagauacaagcaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacguuaa

SEQ ID NO: 8293 - RNA, 1614 nt, Artificial Sequence
  VP1__Norovirus_and/or_Norovirus-like__KF806528
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccacauaguaguagauguuagacaacuggaaccuguguugauccccuuacccgaugucaggaauaauuucuaccacuauaaucaaucaaaagaccccaccaucaaauugauagcaaugcuguacacaccacuuagggcuaauaaugcuugggaagaugucuucacagucucuugccgaguccucacgaggccaucccccgauuuugauuucauauucuuggugccacccacaguugagucaagaucaaaaccauucaccgucccaauuuuaacuguugaggaaaugaccaauucaagguuccccauuccuuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuugcaggcacccacgaauacgcaaugaauuuggcuucucaaaauuggaauaauuaugacccaacagaagaaaucccagccccucugggagccccagauuucgugggaaagauccgaggugugcucacucaaaccacaaggagggacgguucaacccgcggccacagggcuacauugagcacugggagcgcccacuucacuccaaagcugggcagcauucgguuuuccacugauacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggcccccgcuuuuccgggugagcaacugcuuuucuucagguccaccaugcccggaugcagcggguaucccaacaugaauuuggauugucuacuuccacaggaaugggugcagcacuucuaucaagaggcagccccagcacaaucugauguggcucugcuaagauuugugaacccagauacaagcaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacguuaa

SEQ ID NO: 8294 - RNA, 1614 nt, Artificial Sequence
  VP1__Norovirus_and/or_Norovirus-like__KF806527
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaaguccuagccaggucacuauguucccccacauaguaguagauguuagacaacuggaaccuguguugauccccuuacccgaugucaggaauaauuucuaucacuacaaucaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccaauucaagguuccccauuccuuuggaaaagcuguucacgggucccagcagugccuuuguuguccaaccacaaaauggcaggugcacgacugauggcgugcucuuaggcaccacccaacugucuccugucaacaucugcaccuucagaggggaucucacccacuuugcaggcaccuccgaauacgcaaugaauuuggcuucucaaaauuggacuaauuaugacccaacagaagaaaucccagccccccugggagccccagauuucgugggaaagauccgaggugugcucacucaaaccacaaggggggacggcucgacccgcggccacagggcuacauugagcacugggagcgcccacuucacuccaaagcugggcagcguucgguuuuccacugauacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggcccccgcuuuuccgggugagcaacugcuuuucuucagguccaccaugcccggaugcagcggguaucccaacaugaauuuggauugucuacucccacaggaaugggugcagcacuucuaucaagaggcagccccagcacaaucugacguggcucugcuaagauuugugaacccagauacaaguaggguuuuguuugaaugcaagcuccauaaaucagguuaugucacaguggcccacacuggccagcaugauuugguuauucccccuaauggcuacuuuagauuugauuccugggucaaccaauucuacacacuugcccccaugggaaauggaacggggcguagacguuaa

SEQ ID NO: 8295 - RNA, 1614 nt, Artificial Sequence
  VP1__Norovirus_and/or_Norovirus-like__KX514261
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugaaucaagaacuaaaccauuuucugucccaauccuaacuguuggagaaaugaccaauucaagauuucccguaaauuuggaaagauuauucacgggacccagcagugccaauguuguucaaccacaaaauggcaggugcacgauugauggugagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccuuggaacuccagauuuugugggaaagauccaugguaugcucacccaaaccacacagggaaguggcucgacccgggcccauagagcaacaguuuauguugggagugcagaauucacuccaaagcugggcaaaguucaauuucaaacugaaacagaagaugaucuuguaauucgccaaaacacaaaauucaccccagucggugucauccaggaaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggccaauaugauuuaguccuccccucuaaugguuauuuuagguuugauuccugggucaaucaauucuacacacuugcccccaugggaaacggaacggggcguaggcguuaa

SEQ ID NO: 8296 - RNA, 1614 nt, Artificial Sequence
  VP1__Norovirus_and/or_Norovirus-like__AB684720
augaagauggcgucgagugacgccaacccaucugauggguccacagccaaccucgucccagaggucaacaaugagguuauggcucuggagcccguuguuggugccgccauugcagcaccuguagcgggccaacaaaauguaauugaccccuggauuagaaauaauuuuguacaagccccugguggagaguuuacaguguccccuagaaacgcuccaggugagauacuauggagugcgcccuugggcccugauuugaaucccuaucuuucucacuuguccagaauguacaaugguuaugcaggugguuuugaagugcaaguaauccucgcggggaacgcguucaccgccgggaaaaucauauuugcagcaguuccaccaaacuuuccaacugaaggccuaagccccagccagguuacuauguuuccccacauaauuguggauguuaggcaauuggaaccuguauugauuccccuaccugauguuaggaauaauuucuaucauuacaaucaagcacaugauucuacccucaaacuaauagcaauguuguauacaccacucagagcuaauaaugccggggaugaugucuucacagucucuugucgaguucucacgaggccaucccccgauuuugauuuuauauucuuggugccacccacaguugaaucaagaacuaaaccauuuuccgucccaaucuuaacuguugaggaaaugucuaauucaagauuccccauuccuuuggaaaagcuauacacggguccuagcagugcuuuuguuguccaaccacaaaauggcagauguacgacugauggcgugcucuuaggcacuacucagcugucagcugucaauaucugcaacuucaggggggaugucacccacauuaggggcagccgugacuauacaaugaauuuggugucccaaaauuggaacaauuaugacccaacagaagaaaucccagccccccugggaacaccagacuuugugggaaagauccaaggcuugcucacccaaaccacaagagcggacggcucgacccgcgcccacaaagccacagugagcacuggaaguguucacuucacuccaaagcuggguaguguucaauucaccacugauacggacaaugacuuccaaacuggccaaaacacaaaauucaccccaguuggcgucauccaagacagugaccaccaucagaaugaaccccaacaauggguacuuccaaauuacucaggugcgucuggucacaaugugcaucuggccccugccguugcccccacuuucccgggugagcagcuucuuuucuuuagguccacuaugcccggguguagcggguaccccaacaugaauuuggauugccuacucccccaggagugggugcuacacuuuuaucaggaagcagcuccagcacaauccgauguggcucugcugagauuugugaauccagacacagguaggguucuguuugagugcaagcuccauaaaucaggcuacaucacaguggcucacaccggcccguaugauuugguuaucccccccaaugguuauuucagauuugauucuugggucaaccaguucuacacacuugcccccaugggaaauggaacggggcgcaggcguuaa

SEQ ID NO: 8297 - RNA, 1614 nt, Artificial Sequence
  VP1__Norovirus_and/or_Norovirus-like__LC016605
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccagaucacuauguucccccacauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuccaggcacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucgacacugauacaaacaaugaucuugaaacuggccaaaacacaagguucaccccagucggugucauccaggaugguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacguuaa

SEQ ID NO: 8298 - RNA, 1614 nt, Artificial Sequence
  VP1__Norovirus_and/or_Norovirus-like__KF806529
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugauuugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccacauaguaguagaugucagacaacuggaaccuguguugauccccuuacccgaugucaggaauaauuucuaccacuacaaucaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauuuuaacuguugaggaaaugaccaauucaagguuccccauuccuuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuugcaggcacccacgaauacgcaaugaauuuggcuucucaaaauuggaguaauuaugacccaacagaagaaaucccagccccccugggagccccagauuucgugggaaagauccgaggugugcucacucaaaccacaaggggggacggcucgacccgcggccacagggcuacauugagcacugggagcgcccacuucacuccaaagcugggcagcauucgguuuuccacugauacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggcccccgcuuuuccgggugagcaacugcuuuucuucagguccaccaugcccggaugcagcggguaucccgacaugaauuuggauugucuacucccacaggaaugggugcagcacuucuaucaagaggcagccccagcacaaucugauguggcucugcuaagauuugugaacccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagacguuaa

SEQ ID NO: 8299 - RNA, 1614 nt, Artificial Sequence
  VP1__Norovirus_and/or_Norovirus-like__JX023286
augaagauggcgucgagugacgccaacccaucugauggguccgcagccaaccucgucccagaggucaacaaugagguuauggcuuuggagccuguuguuggugcugccauugcagcaccuguggcaggccaacaaaauauaauugaccccuggauuagaaauaauuuuguacaagccccugguggagaguucacaguguccccuagaaacgcuccaggugagauacuauggagcgcgcccuugggcccugauuugaaccccuaucuuucucaccuguccagaauguacaaugguuaugcaggugguuuugaagugcaagugauccucgcagggaacgcguucaccgccgggaaagucauauuugcagcaguuccaccaaauuuuccaacugaaggucuaagccccagccagguuacuauguucccccauauaauuguagauguuaggcaauuggaaccuguauugaucccccuaccugauguuaggaauaauuucuaucauuauaaucaagcacaugauucuacucucaaauugauagcaauguuguacacaccacucagagcuaauaaugccggggaugaugucuuuacagucucuugucgaguccucacgagaccaucccccgauuuugauuuuauauuccuggugccacccacaguugaaucaagaacuaaaccauuuacugucccaaucuuaacuguugaggaaauguccaauucaagauuccccauuccuuuggaaaagcuguacacggguccuagcagugcuuuuguuguccaaccacaaaauggcagaugcacgacugauggcgugcucuuaggcacuacucagcugucagcugucaauaucugcaacuucaggggggaugucacccguguugggaucagccaugauuauacaaugaauuuggugucccaaaauuggaauaauuaugauccaacagaagaaauuccagcuccccugggaacaccagacuuuguaggaaagauccaagguuugcucacccaaaccacaagagcggacggcucgacccgcgcccacaaagcuacagugagcacugggaguguccacuucacuccaaagcuggguaguguucaauucaccaccgauacgaacaaugauuuccaaacuggccaaaacacaaaauuuaccccaguuggugucauccaagacggugaucaccaucagaaugaaccccaacaauggguacucccaaauuacucaggcacaucuggucacaaugugcaucuggccccugccguugcccccacuuucccgggugagcagcuucuuuucuuuagguccacuaugcccggguguagcggguaccccaacaugaauuuggauugccuacucccccaggagugggugcugcacuuuuaccaggaagcagccccagcacaauccgauguggcccugcugagauuugugaauccagacacagguaggguucuguuugagugcaaacuccauaagucaggcuauaucacaguggcucauacuggcccguaugauuugguuaucccccccaaugguuacuucagauuugauucuugggucaaccaguucuacacacucgcccccaugggaaauggaacggggcgcaggcguuaa

SEQ ID NO: 8300 - RNA, 1614 nt, Artificial Sequence
  VP1__Norovirus_and/or_Norovirus-like__FJ537137
augaagauggcgucgaaugacgccaacccaucugauggguccgcagccaaccucgucccagaggucaacaaugagguuauggcucuggagcccguuguuggugccgcuauugcggcaccuguagcgggccaacaaaauguaauugaucccuggauuagaaauaauuuuguacaagccccugguggagaguucacaguguccccuagaaacgcuccaggugagauacuauggagcgcgcccuugggccccgauuugaaucccuaucuuucccauuuguccagaauguacaaugguuaugcaggugguuuugaagugcaaguaauccucgcggggaacgcguucaccgccgggaaagucauauuugcagcaguuccaccaaacuuuccaacugaaggccuaagccccagccagguuacuauguucccccauauaauuguagauguuaggcaauuggaaccuguguuaaucccccuaccugauguuaggaauaauuucuaccacuacaaucaagcacaugauucuacacuuaaguugauagcaauguuguacacaccacucagagcuaauaaugccggggaugacgucuucacagucucuugucgaguucuuacgaggccaucccccgauuuugauuuuauauuccuggugccacccacaguugaaucaagaacuaaaccauucacugucccaauuuuaacuguugaggaaaugucuaauucaagauuucccauuccuuuagaaaagcuauacacggguccuagcagugcuuuuguuguccaaccacaaaauggcagauguacgacugauggcguacucuuaggcacuacccagcugucagcugucaauaucuguaacuucaggggggaugucacccauauuguggguagccaugacuauacaaugaauuugguaucccaaaauuggagcaauuaugacccaacagaagaaaucccagccccccugggaacgccagauuuugugggaaagauccaaggcuuacucacccagaccacaagagcggacggcucgacccgugcccacaaagcuacagugagcacugggaguguccacuucauuccaaagcuggguaguguccaauucaccacggacacgaauaaugacuuccaaacuggccaaaacacaaaauucaccccaguuggugucauccaagacggugaucaccaucagaaugaaccccaacaauggguacucccaaauuacucagguagaacuggucauaaugugcaucuggccccugccgucgcccccacuuuuccgggcgagcagcuucuuuucuuuagauccacugugcccgguuguagcggguaccccaacaugaaucuggauugccuacucccucaggaaugggugucgcacuuuuaccaggaagcagcuccagcacaauccgauguggcucugcugagauuugugaauccagauacagguaggguucuguuugagugcaagcuccauaaaucaggcuauaucacaguggcucacaccggcccguaugauuugguucucccccccaaugguuauuucagauuugauucuugggucaaccaguucuacacacucgcccccaugggaaauggaacggggcguaggcguuaa

SEQ ID NO: 8301 - RNA, 1614 nt, Artificial Sequence
  VP1__Norovirus_and/or_Norovirus-like__X76716
augaagauggcgucgaaugacgccaacccaucugauggguccgcagccaaccucgucccagaggucaauaaugagguuauggcucuggagcccguuguuggugccgcuauugcggcaccuguggcgggccaacaaaacguaauugaccccuggauuagaaacaauuuuguacaagccccugguggagaguucacaguguccccuagaaacgcuccaggugagauacuguggagcgcgcccuugggcccugaucugaaccccuaucuuucucauuuguccagaauguacaaugguuaugcaggugguuuugaagugcaaguaauccucgcggggaacgcguucaccgccgggaaagucauauuugcagcagucccaccaaacuuuccuacugaaggcuuaagccccagccagguuacuauguucccccacauaauuguagauguuagacaauuggaaccuguguugaucccccuaccugauguuaggaauaauuucuaucauuacaaucaagcaaaugauucuacccuuaaguugauagcaauguuguacacaccacucagagcuaauaaugccggggaugaugucuucacagucucuugucgaguccucacgaggccaucccccgauuuugauuuuauauuucuggugccacccacaguugaaucaagaacuaaaccauucacugucccagucuugacuguugaggaaaugucuaauucaagauuccccauuccuuuggaaaagcuuuacacgggcccuaguagugcuuuuguuguccaaccacaaaauggcagauguacgacugauggcguacuucuaggcacuacccagcugucagcuguuaauaucuguaacuuuaggggggauguuacccauauugcggguagccaugauuacacaaugaauuuggcaucccaaaauuggagcaauuaugacccaacagaagagaucccagccccccuaggaacgccagacuuugugggaaagauccaaggcuugcucacccagaccacaagagcggacggcucgacccgugcccacaaagcuacagugagcacugggaguguccacuucacuccaaagcuggguaguguucaauucaccacugacacgaacaaugauuuccaagcuggccaaaacacaaaauucaccccaguuggcgucauccaagacggugaucaccaccagaaugaaccccaacaaugguuacucccaaauuacucagguagaacuggucacaacgugcaccuggccccugcugucgcccccacuuuccccggugagcagcuucuuuucuuuagauccaccaugccaggguguagcggguaccccaacaugaauuuggauugcuuacucccccaggaauggguguugcacuuuuaccaggaagcagccccagcacaauccgauguggcacugcugagauuugugaauccagauacagguaggguucuguuugagugcaagcuucauaaaucaggcuauaucacaguggcccacaccggcccguaugauuugguucuccccccuaaugguuauuucagauuugauucuugggucaaccaguucuacacacucgcccccaugggaaauggaacggggcgcaggcguuaa

SEQ ID NO: 8302 - RNA, 1614 nt, Artificial Sequence
  VP1__Norovirus_and/or_Norovirus-like__KX514328
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguauacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauugggucaacuaaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggggugccaauuucacuccaaagcugggcaaaguucaauuugaaacugauacagucgaugaucuugaaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugugguggacaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8303 - RNA, 1614 nt, Artificial Sequence
  VP1__Norovirus_and/or_Norovirus-like__KX514201
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauguaauaguagauguuaggcaauuggaaccuguguugaucccuuuaccugauguuaggaauaacuucuaucauuauaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccacccacaguugagucaagaacuaaaccauuuucugucccaauccuaacuguuggagaaaugaccaauucaagauuucccauaaauuuggaaagauuauucacgggacccagcagcgccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucaauuuaaaacugaaacagaccaugaucuuacaauucgccaaaacacaaaauucaccccagucggugucauccaggaaagugaucaccaccgagaugaaccccaacaauggaggcucccgaauuauucaggugcaaauaccuuuaauguacaccuagccccugcuguagcccccaauuuccccggugaacagcuucucuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacacuggccaauaugauuugguccuccccucuaaugguuauuuuagguuugauuccugggucaaucaauucuacacacuugcccccaugggaaauggaacggggcguaggcguuaa

SEQ ID NO: 8304 - RNA, 1614 nt, Artificial Sequence
  VP1__Norovirus_and/or_Norovirus-like__AB985442
augaagauggcgucgagugacgccaacccaucugauggguccgcagccaaccucgucccagaggucaacaaugagguuauggcucuggagcccguuguuggugccgcuauugcggcaccuguagcgggccaacaaaauauaauugaccccuggauuagaaauaauuuuguacaagccccugguggagaguuuacaguguccccuagaaacgcuccaggugagauacuauggagcgcgcccuugggcccugauuugaaccccuaucuuucucauuuguccagaauguacaaugguuaugcaggugguuuugaagugcaaguaauccucgcggggaacgcguucaccgccgggaaaguuauauuugcagcaguuccaccaaacuuuccaacugaaggcuuaagccccagccagguuacuauguucccccauauaauuguagauguuaggcaauuggaaccuguguugaucccccuaccugauguuaggaauaauuucuaucauuacaaucaaucacaugauucuacccuuaaguugauagcaauguuguacacaccacucagggcuaauaaugccggagaugaugucuucacagucucuugucgaguucucacuaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacggguccuagcagugcuuuuguuguccaaccacaaaauggcagaugcacgacugauggcgugcucuuaggcacuacccagcugucagcugucaacaucuguaacuucaggggggaugucacccauauugugggcagccaugauuauacaaugaaucuggcuucccaaaauuggagcaauuaugacccaacagaagaaaucccagcuccccugggaacaccagauuuuguggggaagauccaaggccugcgcacccagaccacaagagcggauggcucgacccgugcccacaaagcuacagugagcacugggaguguccacuucacuccaaagcuggguaguguucaauucaccaccgacacaaacaaugauuuccaaacuggccaaaacacgaaauucaccccaguuggcgucauccaagacggugaucaccaucagaaugagccccaacaauggguacucccaaacuacucagguagaacuggucauaaugugcaccuggccccugccguugcccccacuuuuccgggugagcaacuccuuuucuuuagauccacuaugcccggguguagcggguaccccaacaugaauuuggauugccuacucccccaggaaugggugcugcacuucuaccaggaagcagcuccagcacaauccgauguggcucugcugagauuugugaauccagacacagguaggguucuguuugagugcaagcuccauaaaucaggcuauaucacaguggcucacaccggcccguaugacuugguuaucccccccaaugguuauuucagauuugauuccugggucaaccaguucuacacacuugcccccaugggaaauggaacggggcgcaggcguuaa

SEQ ID NO: 8305 - RNA, 1614 nt, Artificial Sequence
  VP1__Norovirus_and/or_Norovirus-like__LC016604
augaagauggcgucgaaugacgccagcccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagucccaccaaauuucccaacugaaggcuugagccccagccaggucacuauguucccccauauaauaguagauguuaggcaauuggaaccuguguugauccccuuaccugauguuaggaauaauuucuaccacuacaaucaaucaaaugacuccaccauuaaauugauagcaaugcuguacacaccacuuagggcuaauaaugcuggggaugaugucuucacagucucuugucgaguccucacgagaccaucccccgauuuugauuucauauuucuggugccacccacaguugagucaagaaccaaaccauucaccgucccaauuuuaacuguugaggaaaugacuaauucaagauuccccauuccuuuggaaaaauuguucacgggucccagcagugccuuugucguccaaccacaaaauggcaggugcacgacugauggcgugcucuuaggcacuacccaacugucccccgucaacaucugcaccuucagaggggaugucacccacauuccaggcacucguacuuacagaaugaauuuggcuucucaaaauuggaacaauuaugacccaacagaagaaaucccagccccucugggaacuccagauuucgugggaaagauccaaggcaugcucacccaaaccacaaagggagacggcucgacccgcggucacaaagcuacagugagcacugggagugucgacuucacuccaaagcugggcagcguucaguucgacacugauacaaacaaugaucuugaaacuggccaaaacacaagguucaccccagucggugucauccaggaugguagugcccacagaaaugaaccccaacaauggguacucccagauuacucagguagaacuguucauaauguacaccuagccccugccguagcccccacuuuuccgggugagcaacuucuuuucuucagaucuacuaugcccggaugcaguggguaucccaauauggauuuggauugucuacucccccaggaaugggugcagcacuucuaccaagaggcagcuccagcacaaucugauguggcuuugcugagauucgugaauccagacacagguaggguucuguuugagugcaagcuucauaaaacaggcuaugucacaguggcucacacuggccagcaugauuuggucaucccccccaauggcuacuuuagauuugauuccugggucaaccaguucuacacacuugcccccaugggaaauggagcggggcguagacguuaa

SEQ ID NO: 8306 - RNA, 1614 nt, Artificial Sequence
  VP1__Norovirus_and/or_Norovirus-like__KF806532
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgauguuaggaauaauuucuaccacuauaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccaauucaagguuccccauuccuuuggaaaagcuguucacgggucccagcagugccuuuguuguccaaccacaaaauggcaggugcacgacugauggcgugcucuuaggcaccacccaacugucuccugucaacaucugcaccuucagaggggaucucacccacuuugcaggcaccuccgaauacgcaaugaauuuggcuucucaaaauuggacuaauuaugacccaacagaagaaaucccagccccccugggagccccagauuucgugggaaagauccgaggugugcucacucaaaccacaaggagggacggcucgacccgcggccacagggcuacacugagcacugggagcgcccacuucacuccaaagcugggcagcauucgguuuuccacugauacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggcccccgcuuuuccgggugagcaacugcuuuucuucagguccaccaugcccggaugcagcggguaucccaacaugaauuuggauugucuacuuacacaggaaugggugcagcacuucuaucaagaggcagccccagcacaaucugauguggcucugcuaagauuugugaacccagauacaaguaggguuuuguuugagugcaagcuccauaaaucagguuaugucacaguggcccauacuggccagcaugauuugguuauccccccuaauggcuacuuuagauuugauuccugggucaaccaauucuacacucuugcccccaugggaaauggaacggggcguagacguuaa

SEQ ID NO: 8307 - RNA, 1614 nt, Artificial Sequence
  VP1__Norovirus_and/or_Norovirus-like__FJ537138
augaagauggcgucgagugacgccaacccaucugauggguccgcagccaaccucgucccagaggucaacaaugagguuauggcuuuggagccuguuguuggugccgccauugcagcaccuguagcaggccaacaaaauguaauugaccccuggauuagaaauaauuuuguacaagccccugguggagaguuuacaguguccccuagaaacgcuccaggugagauacuauggagcgcgcccuugggcccugauuugaaccccuaucuuucucaccuguccagaauguacaaugguuaugcaggugguuuugaagugcaaguaauccucgcagggaacgcguucacugccgggaaagucauauuugcagcaguuccaccaaauuuuccaacugaaggucuaagccccagccagguuacuauguucccccauauaauuguagauguuaggcaacuggaaccuguauugaucccccuaccugauguuaggaauaauuucuaucauuauaaucaagcacaugauucuacccuaaaauugauagcaauguuguauacaccacucagagcuaauaaugccggagaugaugucuuuacagucucuugucgaguccucacgagaccaucccccgauuuugauuuuauauuccuggugccacccacaguugaaucaagaacuaaaccauuuacugucccaaucuuaacuguugaggaaauguccaauucaagauuccccauuccuuuggaaaagcuguacacggguccuagcagugcuuuuguuguccaaccacaaaauggcagaugcacgacugauggcgugcucuuaggcacuacucagcugucagcugucaauaucugcaacuucaggggggaugucacccguguugggaucagccaugauuauacaaugaauuuggugucccaaaauuggaauaauuaugacccaacagaagaaauuccagcuccccugggaacgccagacuuugugggaaagauccaagguuugcucacccaaaccacaagagcggacgguucgacccgcgcccacaaagcuacagugagcacugggaguguccacuucacuccaaagcuggguaguguucaauucaccaccgauacgaacaaugauuuccaaacuggccaaaacacaaaauuuaccccaguuggugucauccaagacggugaucaccaucagaaugaaccccaacaauggguacucccaaauuacucaggcacaucuggucacaaugugcaucuggccccugccguugcccccacuuucccgggugagcagcuucuuuucuuuagguccacuaugcccggguguagcggguaccccaacaugaauuuggauugccuacucccccaggagugggugcugcacuuuuaccaggaagcagccccagcacaauccgauguggcucuguugagauuugugaauccagacacagguaggguucuguuugagugcaaacuccauaaaucaggcuauaucacaguggcucacaccggcccguaugauuugguuaucccccccaaugguuacuucagauuugauucuugggucaaccaguucuacacacucgcccccaugggaaauggaacggggcgcaggcguuaa

SEQ ID NO: 8308 - RNA, 1614 nt, Artificial Sequence
  VP1__Norovirus_and/or_Norovirus-like__AY030098
augaagauggcgucgagugacgccaacccaucugauggguccacagccaaccucguuccagaggucaacaaugagguuauggcucuggagcccguuguuggugccgcuauugcggcaccuguagcgggccaacaaaauauaauugaccccuggauuagaaacaauuuuguacaagccccugguggagaguuuacaguguccccuagaaacgcuccaggcgagauacuauggagcgcgcccuugggcccugacuugaaccccuaucuuucccauuuguccagaauguacaaugguuaugcaggugguuuugaagugcaaguaauccucgcggggaacgcguucaccgccgggaagguuauauuugcagcagucccaccaaacuuuccaacugaaggcuuaagccccagccagguuaccauguucccccauauaauuguagauguuaggcaauuggaaccuguguuaaucccccuaccugauguuaggaauaauuucuaucauuacaaccaaucacaugauucuacccucaaguugauagcaauguuguauacaccacucagggcuaauaaugccggggaugaugucuucacaguuucuugucgaguucucacgaggccaucccccgauuuugauuuuauauuccuggugccacccacaguugaaucaagaaccaaaccauucaccgucccaaucuuaacuguugaggaaaugucuaauucaagauuccccauuccuuuggaaaaguuauacacggguccuagcagugcuuuuguuguccaaccacaaaauggcagauguacgacugacggcgugcucuuaggcacuacucagcugucagcugucaauaucuguaacuucaggggggaugucacccacauugugggcagccaugauuauacaaugaaucuggugucccaaaauuggaguaauuaugacccaacagaagaaaucccagccccccugggaacaccagauuucguggggaagauccaaggccugcucacccagaccacaagagcggauggcucgacccgugcccacaaggcuacggugagcacugggaguguccacuucacuccaaagcuggguaguguucaauucaccacugacacaaacaaugauuuccaaacuggccaaaauacgaaauucaccccaguuggugucauccaagacggugaucaccaucagaaugaaccccagcaauggguacucccagauuacucagguagaacuggucauaaugugcaccuggccccugccguugccccuacuuuuccgggugagcaacuccucuucuuuagauccaccaugcccggguguagcggguaccccaacaugaauuuggauugccuacucccccaggaaugggugcugcacuucuaccaggaagcagcuccagcacaguccgauguggcucugcugagauuugugaauccagacacagguaggguucuguuugagugcaagcuccauaaaucaggcuauaucacaguggcucacaccggcccguaugauuugguuaucccccccaaugguuauuuuagauuugacuccugggucaaccaguuuuacacacuugcccccaugggaaauggaacggggcgcaggcguuaa

SEQ ID NO: 8309 - RNA, 1614 nt, Artificial Sequence
  VP1__Norovirus_and/or_Norovirus-like__AY532130
augaagauggcgucgaaugacgccaacccaucugauggguccacagccaaccucgucccagaggucaacaaugagguuauggcuuuggagcccguuguuggugccgcuauugcggcaccuguagcgggccaacaaaauauaauugaccccuggauuagaaauaauuuuguacaagccccugguggagaguuuacaguauccccuagaaacgcuccgggugagauacuauggagcgcgcccuugggcccugauuugaaccccuaccuuucucaucuggccagaauguacaaugguuaugcaggugguuuugaagugcagguaauccucgcggggaacgcguccaccgccgggaaaaucauauuugcagcagucccaccaaauuuuccaacugaaggcuugagccccagccagguuacuauguucccccauauaauaguagauguuaggcaauuggaacccguguugauccccuuaccugauguuaggaacaauuucuaucauuacaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaauuaaaccauucaccgucccaaucuuaacuguugaggaaauguccaauucaagguuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggauguuacccacauugcaggcagucaugauuauacaaugaauuuggcuucucaaaauuggaacaauuaugacccaacagaagaaaucccagccccucugggaacuccagauuucgugggaaagauccaagguaugcucacccaaaccacaagagaggauggcucgacccgcgcccacaaagcuacaguaagcacugggagugcccacuuuacuccaaagcugggcaguguucaauacaccacugacacaaacaaugauuuucaaacuggccaaaacacgaaguucaccccagucggcgucauccaggacgguaauaaccaucaaaaugaaccccaacaauggguacucccaaguuacucaggcagaacuggccauaaugugcaccuagcuccugccguugcccccacuuuuccgggugagcaacuucuuuucuuuagguccacuaugcccggauguagcggguaucccaacaugaaucuggauugccuacucccccaggaaugggugcagcacuucuaccaagaagcagcuccagcacaaucugauguggcucugcugagauucgugaauccagauacagguaggguucuguuugagugcaagcuccauaaaucaggcuaugucacaguggcucacacuggcccgcaugauuugguuaucccccccaaugguuacuuuagauuugauuccugggucaaccaguucuacacacuugcccccaugagaaauggagcggggcguagacguuaa

SEQ ID NO: 8310 - RNA, 1614 nt, Artificial Sequence
  VP1__Norovirus_and/or_Norovirus-like__KX514286
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggagugccgauuucacuccaaagcugggcaaaguucaauuugaaacugauacagaagaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8311 - RNA, 1614 nt, Artificial Sequence
  VP1__Norovirus_and/or_Norovirus-like__KX514202
augaagauggcgucgagugacgccaacccaucugauggguccgcagccaaccucgucccagaggucaacaaugagguuauggcuuuggagcccguugucggugccgcuaucgcggcgccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgcuggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuucauauuucuggugccaccuacaguugagucaagaacuaaaccauuuucugucccaauccuaacuguuggagaaaugaccaauucaagauuucccauaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucaauuuaaaacugaaacagaccaugaucuuacaauucgccaaaacacaaaauucaccccagucggugucauccaggaaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggauuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggccaauaugauuugguccuccccucuaaugguuauuuuagguuugauuccugggucaaucaauucuacacacuugcccccaugggaaauggaacggggcguaggcguuaa

SEQ ID NO: 8312 - RNA, 1614 nt, Artificial Sequence
  VP1__Norovirus_and/or_Norovirus-like__DQ358208
augaagauggcuuccaaugacgcuaacccuucugaugguuccgcugcuaaccuggugccugaggugaacaaugaggugauggcucuggaaccuguggucggugcugccauugcugccccuguggcuggucagcaaaacgugauugacccuuggauccguaacaauuucgugcaggcuccugguggcgaguucacuguguccccucguaacgcuccuggugagauccuguggucugcuccucuggguccugaccugaacccuuacuugucucacuugucccguauguacaacgguuacgcugguggcuucgaggugcaggugauccuggcugguaaugcuuucacugcugguaaagugaucuucgcugccgugccucccaacuucccuacugaggguuuguccccuucccaggugacuauguucccucacaucauuguggaugugcgucaguuggaaccugugcugaucccucugccugaugugcguaacaauuucuaccacuacaaccaagcuaacgacucuacccugaaguugauugcuaugcuguacaccccucugcgugcuaacaaugcuggugacgauguguucacugugucuugccgugugcugacccguccuuccccugacuucgacuucaucuuccuggugccucccacuguggagucccguaccaaaccuuucacugugccugugcugacuguggaggaaauguccaacucccguuucccuauuccucuggagaagcuguacacugguccuuccucugcuuucgugguccagccucaaaacggucguugcaccacugauggugugcuccuggguaccacucaacugucugcugugaacaucugcaacuuccguggugaugugacccacauugcugguucucacgacuacaccaugaaccuggcuucccaaaacugguccaacuacgacccuaccgaagagaucccugcuccucuggguacuccugacuucguggguaagauccagggucugcucacccagaccacucgugcugacgguuccacccgugcucacaaagcuacuguguccaccgguuccgugcacuucaccccuaagcuggguucugugcaguucaccacugacaccaacaaugacuuccaggcuggucagaacacuaaguucaccccugugggugugauccaggacggugaccaccaccagaacgaaccucagcaauggucccugccuaacuacucuggucguaccggucacaacgugcaccuggcuccugcuguggcuccuaccuucccuggugagcaacugcuauucuuccguuccaccaugccugguugcucugguuacccuaacaugaaccuggacugccugcucccucaggaaugggugcugcacuucuaccaggaggcugccccugcucagucugacguggcucugcuccguuucgugaacccugacaccggucgugugcuguucgagugcaagcugcacaagucugguuacaucaccguggcucacaccgguccuuacgaccuggugcugccucccaacgguuacuuccguuucgacucuugggugaaccaguucuacacucuggcuccuauggguaacgguacuggucgucgccguuaa

SEQ ID NO: 8313 - RNA, 1614 nt, Artificial Sequence
  VP1__Norovirus_and/or_Norovirus-like__AF414425
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacagcauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauucccuuaccugauguuaggaacaauuucuaccauuacaaucaaucaaaugauucuaccauuaaauugauagcaaugcuguauacaccacuuagggcuaauaaugcuggggaugaugucuucacagccucuugucgaguccucacgaggccaucccccgauuuugauuucauauucuuggugccacccacaguugaaucaagaacuaaaccauucaccgucccaaucuuaacuguugaggaaauguccaauucgagauuccccauuccuuuggaaaaguuguacacgggccccagcagugcuuuuguuguccaaccacaaaguggcaggugcacgacugauggcgugcucuuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugagcacugggaguguccacuuuacuccaaagcugggcaguguucaauacaccacugacacaaacaaugauuuccaaacuggccaaaacacgaaauucaccccagucggcgucauccaggacgguaauaaccaucaaaaugaaccccaacaauggguacucccaaauuacucaggcagaacuggucauaaugugcaccuagcuccugccguugcccccaccuuuccgggugagcaacuucuuuucuuuaagucuacuaugcccggauguagcggguaucccaacaugaaucuggauugccuacucccccaggaaugggugcagcacuucuaccaagaagcagcuccagcacaaucugauguagcucugcugagauuugugaauccagauacagguaggguuuuguuugagugcaagcuccauaaaucaggcuaugucacaguggcucacacugguccgcaugauuugguuaucccccccaaugguuacuuuagauuugacuccugggucaaccaguucuacacacuugcccccaugggaaauggagcggggcguagacguuaa

SEQ ID NO: 8314 - RNA, 1614 nt, Artificial Sequence
  VP1__Norovirus_and/or_Norovirus-like__KX514348
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcaggugcacgauugauggcgagcuuuuaggcaccacccaacugucuucuguuaacauuugcaccuucagaggggacguuacucaaauugggucaacuaaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggggugccaauuucacuccaaagcugggcaaaguucaauuugaaacugauacagucgaugaucuugaaauucgccaaaacacaaaauucaccccagucggugucauccagucaagugaucaccaccgagaugaaccccaacaaugggugcucccaaguuauucagguagagauacccccaauguacaucuagccccugcuguagcccccaauuuccccggugaacagcuucuuuucuucagguccacucugcccggauguggugggcaccacaacauggacuuggauugccugcucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8315 - RNA, 1614 nt, Artificial Sequence
  VP1__Norovirus_and/or_Norovirus-like__KX514287
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguauccccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgcuggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacggggcccagcagugccaauguuguucaaccacaaaauggcaggugcacgauugauggcgagcucuuaggcaccacccaacugucuucuguuaacauuugcaccuucagaggggacguuacucaaauugggucaacucaccauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggagugccgauuucacuccaaagcugggcaaaguucaauuugaaacugauacaggcgaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8316 - RNA, 1614 nt, Artificial Sequence
  VP1__Norovirus_and/or_Norovirus-like__KX514183
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguauccccuagaaacgcuccaggugaaauacuauggagcgcgcccuuagguccugaccugaaucccuaccuaucucauuuggccagaauguauaaugguuaugcaggugguuuugaagugcagguaauccucgcggggaacgcguucaccgccggaaaaauuauauuugcagcagucccaccaaccuucccaacugaaggcuugagucccagucaggucaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggacaacucaacauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucgauuugaaacugauacagaagaugaucuuguaauucgccaaaacacaaaauucaccccagucggugucauccagucaagugaacaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8317 - RNA, 1614 nt, Artificial Sequence
  VP1__Norovirus_and/or_Norovirus-like__KX514174
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcaggugcacgauugauggcgagcucuuaggcaccacccaauugucuucuguuaacauuugcaccuucagaggggacguuacucacauugggacaacucaacauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucgauuugaaacugauacagaagaugaucuuguaauucgccaaaacacaaaauucaccccagucggugucauccagucaagugaacaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucagguuaugucacaguggcucacaccggucaacaugauuuggucaucccucccaauggcuacuuuagguuugauuccuggguuaaucaauucuacacacuugcccccaugggaaauggaacggggcguaagcguuaa

SEQ ID NO: 8318 - RNA, 1614 nt, Artificial Sequence
  VP1__Norovirus_and/or_Norovirus-like__KF429791
augaagauggcgucgagugacgccaacccaucugauggguccacagccaaccucgucccagaggucaacaaugagguuauggcuuuggagcccguuguuggugccgccauugcggcgccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccggaaaaaucauauuugcagcagucccaccaaauuucccaacugaaggcuugagccccggccagguuacuauguucccccauauaauaguagauguuaggcaacuggaaccuguguugauccccuuacccgauguuaggaauaauuucuaucacuacaaucaaucaaaugaccccaccaucaaauugguagcaauguuguauacaccucuuagggcuaauaaugcuggggacgaugucuucacaguuucuugucggguacucacgagaccaucccccgauuuugauuucauauuuuuagugccacccacaauugaaucaaaaacuaaaucauucucugucccaauuuuaacuauugaggagaugaccaauucaagauuccccauuccuuuggaaaagcuguucacgggccccagcaguacccuuguuguucaaccacaaaauggcaggugcacgacugauggcgugcuccuagguaccacccaacugucuccugucaacaucugcaccuucagaggggacgucacccaaauuacaaauacucacagcuacgaaaugaauuuggcugcucaaaauuggaacaguuaugacccaacagaagaaaucccagccccccuaggaacuccagauuucgugggaaagauccaaggugugcucacccaaaccacgaaggaaaauggcucaacccgugcccacaaagcuacaguguacacugggagcaccggauuuacuccaaaacuggguagaguccaauuugucacugacacagacagagaucuugaaacuaaccaagacacaaaguucaccccagucggugucauccaggauggugaugcccaccaaaaugaaccccaacaauggguacucccaaguuacuuagguacaaauaaucacaaugugcaccuggcccccgcuguagcccccacuuuuccgggcgagcaacuucucuucuucagauccacuaugcccggaugcagcggguaccccaacaugaauuuggacugucugcuuccccaggaaugggugcaauauuucuaucaagaggcagccccagcacaaucugauguggcuuugcuaagauuugugaauccagacacagguaggguuuuguuugaguguaagcuucauaaaucagguuaugucacaguggcucacaccggccgccaugauuugguuaucccccccaaugguuauuucagauuugauuccugggucagccccuucuacacacuugcccccaugggaaauggaacggggcguagacguuaa

SEQ ID NO: 8319 - RNA, 1614 nt, Artificial Sequence
  VP1__Norovirus_and/or_Norovirus-like__AF427115
augaagauggcgucgaaugacgccaacccaucugauggguccacagccaaccucgucccagaggucaacaaugagguuauggcuuuggagcccguuguuggugccgcuauugcagcaccuguagcgggccaacaaaauguaauugaccccuggauuagaaauaauuuuguacaagccccugguggagaguuuacaguauccccuagaaacgcuccgggugagauacuauggagcgcgccccucggcccugauuugaaccccuaccuuucucauuuggccagaauguacaaugguuaugcaggugguuuugaagugcagguaauccucgcggggaacgcguucaccgccgggaagaucauauuugcagcagucccaccaaauuuuccaacugaaggcuugagccccagccagguuacuauguucccccauauaauaguagauguuaggcaauuggaaccuguguugauucccuuaccugauguuaggaacaauuucuaccauuauaaucaaucaaaugauucuaccauuaaauugauagcaaugcuguauacaccacuuagggcuaacaaugcuggggaugaugucuucacagucucuugucgaguccucacgaggccaucccccgauuuugauuucauauucuuggugccacccacaguugaaucaagaacuaaaccauucaccaucccaaucuuaacuggugaggaaauguccaauucaagauuccccauuccuuuggaaaaguuguauacgggucccagcagugcuuuuguuguccaaccacaaaauggcaggugcacgacugauggcgugcuccuaggcacuacccagcugucugcugucaacaucugcacuuucaaagggaaugucauccacauugcaggcagucaugauuauaccaugaauuuggcuucucaaaauuggaacaauuaugacccaacagaagaaaccccagccccucugggaacuccagauuucgugggaaagauccaaggcuugcucacccaaaccacaagagaggauggcucgacccgcgcccacaaagcuacaguuagcgcugggaguguccacuuuacuccaaagcuggguaguguucaguacaccacugacacaaacaaugauuuucaaacuggccaaaauacgaaauucaccccagucggcgucauccaggacgguaauaaccaucaaaaugaaccucaacaauggguacucccaaauuacucaggcagggcuggacauaaugugcaccuagcuccugccguugcccccacuuuuccgggugagcaacuucuuuucuuuagguccacuaugcccggauguagcggguaucccaacaugaaucuggacugccuacucccccaggaaugggugcagcacuucuaccaggaagcagcuccagcacaaucugauguggcucugcugagauuugugaacccagauacagguaggguuuuguuugaguguaagcuccauaaaucaggcuaugucacaguggcucacacuggcccgcaugauuugguuaucccccccaaugguuacuuuagauuugauuccugggucaaucaauuuuacacacuugcccccaugggaaauggagcggggcguagacguuaa

SEQ ID NO: 8320 - RNA, 1614 nt, Artificial Sequence
  VP1__Norovirus_and/or_Norovirus-like__KX514314
augaagauggcgucgaaugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauugggucaacuaaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggggugccaauuucacuccaaagcugggcaaaguucaauuugaaacugauacaggcgaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8321 - RNA, 1614 nt, Artificial Sequence
  VP1__Norovirus_and/or_Norovirus-like__KX514208
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaauuuggaaagauuguucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucaauuuaaaacugaaacagaccaugaccuuucaauucgccaaaacacaaaauucaccccagucggugucauccaggaaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacaugaacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggccaauaugauuugguccuccccucuaaugguuauuuuagguuugauuccugggucaaucaauucuacacacuugcccccaugggaaauggaacggggcguaggcguuaa

SEQ ID NO: 8322 - RNA, 1614 nt, Artificial Sequence
  VP1__Norovirus_and/or_Norovirus-like__KX514206
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguaucuccuagaaacgcuccaggugaaauacuauggagcgcgcccuuaggcccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaacaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcuggguaaaguucaauuuaaaacugaaacagaccaugaccuuucaauucgccaaaacacaaaauucaccccagucggugucauccaggaaagugaucaccaccgagaugaaccccaacaauggaggcucccaaauuauucaggugcaaauaccuucaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggccaauaugauuugguccuccccucuaaugguuauuuuagguuugauuccugggucaaucaauucuacacacuugcccccaugggaaauggaacggggcguaggcguuaa

SEQ ID NO: 8323 - RNA, 1614 nt, Artificial Sequence
  VP1__Norovirus_and/or_Norovirus-like__KX514198
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucaauuuaaaacugaaacagaccaugaucuuacaacucgccaaaacacaaaauucaccccagucggugucauccaggaaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggccaauaugauuugguccuccccucuaaugguuauuuuagguuugauuccugggucaaucaauucuacacacuugcccccaugggaaauggaacggggcguaggcguuaa

SEQ ID NO: 8324 - RNA, 1614 nt, Artificial Sequence
  VP1__Norovirus_and/or_Norovirus-like__KX514191
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguauccccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagccaggucaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggacaacucgucauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucgauuugaaacugauacagaagaugaucuuguaauucgccaaaacacaaaauucaccccagucggugucauccagucaagugaacaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8325 - RNA, 1614 nt, Artificial Sequence
  VP1__Norovirus_and/or_Norovirus-like__KX514187
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguauccccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggacaacucgucauuggacaaugaauuuggucucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucgauuugaaacugauacagaagaugaucuuguaauucgccaaaacacaaaauucaccccagucggugucauccagucaagugaacaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuacuuuagguuugauuccugggucaaucaauucuacacacuugcccccaugggaaauggaacggggcguaggcguuaa

SEQ ID NO: 8326 - RNA, 1614 nt, Artificial Sequence
  VP1__Norovirus_and/or_Norovirus-like__KX514180
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuauucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauugggucaacucaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggagugccaauuucacuccaaagcugggcaaaguucaauuugaaacugauacaggcgaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuagauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8327 - RNA, 1614 nt, Artificial Sequence
  VP1__Norovirus_and/or_Norovirus-like__GU598213
augaagauggcuucuaaugaugccaacccuagugauggauccacagcaaaccuuguuccagagguuaacaaugagguuauggcucuugagccuguuguuggugcugccauugcugcaccuguugcuggacaacagaauguuauugacucuuggauuaggaacaacuuugugcaagcaccugguggagaguuuacagugucuccuaggaaugcuccaggugagauacuuuggagugcuccucuuggaccugauuugaauccuuaucuuucucauuuggcuaggauguacaaugguuaugcugguggcuuugaaguccaagugauucuugcugguaaugccuucacugcuggcaagauuauauuugcugcuguuccaccuaacuuuccuacugaaggcuugucaccuagccaaguuacuauguucccucacauaauuguggauguuagacaauuggagccuguguugauuccauuaccugauguuaggaauaacuucuaucauuauaaccagagcaaugauagcacuaucaaauugauugcaaugcucuauacaccucuuagggcuaacaaugcuggagaugauguauucacaguuucuuguaggguccuuacuaggccuucaccagacuuugauuucauauucuuggugccaccuacaguugagucaaggacuaaaccauucacuguaccaauucuuacuguugaggagauguccaacucaagguuuccaauaccuuuggagaaguuguacacaggucccucuagugccuuuguuguacaaccucagaaugguagguguaccacugauggagugcucuuaggaacuacccaacuuagugcugucaacauuuguaccuuuagaggagaugucacccauauugcugguucccaugacuacacuaugaacuuggccucucagaauuggagcaauuaugauccaacagaagagauuccagcuccucuugguacuccagacuuugugggaaagauccaaggcaugcucacccagaccacaagagaagauggauccacuagagcccacaaggcuacaguguccacugguaguguucacuucacucccaagcuugguaguguucaguauaccacagacacaaacaaugauuuccaaacuggacagaacacuaaauucacuccaguaggagugauccaagauggaaauaaccaucagaaugagccacaacaaugggugcucccaaauuauagugguagaacuggacauaaugugcaucuugcaccugcuguugcacccacuuucccaggugaacaauuauuguucuuuagguccacuaugccaggauguagugguuaucccaacaugaaucuugauugccuucucccucaagaaugggugcaacacuuuugccaagaagcugcaccagcacaaagugauguggcacugcuuagguuugugaauccagauacagguagggucuuguuugagugcaagcuccacaagaguggcuauguuacaguggcacauacuggcccacaugauuugguuaucccucccaaugguuacuuuagguuugacucaugggucaaucaguucuacacacuugcaccaaugggaaauggugcugguagaaggagauaa

SEQ ID NO: 8328 - RNA, 1614 nt, Artificial Sequence
  VP1__Norovirus_and/or_Norovirus-like__KX514365
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuuuccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauuaggucaacucaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggagugccaauuucacuccaaagcugggcaaaguucaauuugaaacugauacaggcgaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuagauugccugcucccccaggagugggugcagcacuucuaccaagaggcagcuccagcacaaucugauguagcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8329 - RNA, 1614 nt, Artificial Sequence
  VP1__Norovirus_and/or_Norovirus-like__KX514304
augaagauggugucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauugggucaacuaaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggggugccaauuucacuccaaagcugggcaaaguucaauuugaaacugauacaggcgaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8330 - RNA, 1614 nt, Artificial Sequence
  VP1__Norovirus_and/or_Norovirus-like__KX514302
augaagauggcgucgagugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguucaagccccugguggagaguucaccguauccccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuucauauuccuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauugggucaacucaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggggugccaauuucacuccaaagcuagguagaguucaauuugaaacugacacaacugaugaucuugaugcucaccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8331 - RNA, 1614 nt, Artificial Sequence
  VP1__Norovirus_and/or_Norovirus-like__KX514207
augaagauggcgucgagugacgccaacccaucugauggguccgcagccaaccucgucccagaggucaacaaugagguuauggcuuuggagcccguugucggugccgcuauuacggcgccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggucucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucaauuuaaaacugaaacagaccaugaccuuucaauucgccaaaacacaaaauucaccccagucggugucauccaggaaagugaucaccaccgagaugaaccccaacaauggaggcucccaaauuauucaggugcaaaugccuucaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggccaauaugauuugguccuccccucuaaugguuauuuuagguuugauuccugggucaaucaauucuacacacuugcccccaugggaaauggaacggggcguaggcguuaa

SEQ ID NO: 8332 - RNA, 1614 nt, Artificial Sequence
  VP1__Norovirus_and/or_Norovirus-like__KX514192
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguauccccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcaggugcacgauugauggcgagcuuuuaggcaccacccaacugucuucuguuaacauuugcaccuucagaggggacguuacucacauuggggcaacucgucauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucgauuugaaacugauacagaagaugaucuuguaauucgccaaaacacaaaauucaccccagucggugucauccagucaagugaacaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggccaauaugauuugguccuccccucuaaugguuauuuuagguuugauuccugggucaaucaauucuacacacuugcccccaugggaaauggaacggggcguaggcguuaa

SEQ ID NO: 8333 - RNA, 1614 nt, Artificial Sequence
  VP1__Norovirus_and/or_Norovirus-like__KF806525
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaauuuuguacaagccccugguggagaguucacaguguccccuagaaacgcuccaggugaaauacuauggagcgcacccuuaggcccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaagaucccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauucuaacuguugaggaaaugaccuauucaagguuccccauuccuuuggaaaagcuguucacgggucccagcagugccuuuguuguccaaccacaaaauggcaggugcacgacugauggcgugcucuuaggcaccacccaacugucuccugucaacaucugcaccuucagaggggaucucacccacuuugcaggcaccuccgaauacgcaaugaauuuggcuucucaaaauuggacuaauuaugacccaacagaagaaaucccagccccccugggagccccagauuucgugggaaagauccgaggugugcucacucaaaccacaaggggggacggcucgacccgcggccacagggcuacauugagcacugggagcgcccacuucacuccaaagcugggcagcguucgguuuuccacugauacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggcccccgcuuuuccgggugagcaacugcuuuucuucagguccaccaugcccggaugcagcggguaucccaacaugaauuuggauugucuacucccacaggaaugggugcagcacuucuaucaagaggcagccccagcacaaucugacguggcucugcuaagauuugugaacccagauacaaguaggguuuuguuugaaugcaagcuccauaaaucagguuaugucacaguggcccacacuggccagcaugauuugguuauucccccuaauggcuacuuuagauuugauuccugggucaaccaauucuacacacuugcccccaugggaaauggaacggggcguagacguuaa

SEQ ID NO: 8334 - RNA, 1614 nt, Artificial Sequence
  VP1__Norovirus_and/or_Norovirus-like__KC462195
augaagauggcgucgaaugacaccaucccaucugaugggucgacagccaaccucgucccagaggucaacaaugagguuauggcuuuggagccuguuguuggagcugcuauugcagccccaguggcaggucaacaaaauguaauugaccccuggauuagaaauaauuuugugcaagcccccgguggagaguucacgguuuccccuagaaaugccccaggugaaauauuguggaguaugccacugagcccugauuugaaccccuaccuaucacacuuguccaggauguacaauggguaugcaggugguuuugaggugcaggugauccuugcggggaaugcguucaccgcggggaagaucauauucgccgcaauuccaccaaauuuucccacugauggccugaguccuagucaggucaccauguuuccucacauaauuguggauguuaggcaauuggaaccaguguugauccccuuaccugauguuagaaauaauuucuaucauuauaaucagguuaaugauuccacuuugaagcugauagcuauguuguacacaccacuuagagcuaacaaugcuggggaugauguuuucacugucucuugucgugugcugacacgaccauccccugauuuugauuucauauucuugguccccccuacaguugagucaagaacaaagccuuucacuguccccauauugacuguugaugagaugacuaauucuagguuucccaccccccuggaaagauugcacacgggcccaaacaauucucuggucguccagccccaaaaugggaggugcacaauugaugguguucuuuugggcaccacgcaguugucagcugucaacaucugcagcuuuagaggggauagcaccacacgugaaggccagucacaugccuacacgaugaauuuggcuucucaaaacuggacuaauuaugacccaacagaggacauaccagcuccuuuggggacaccagauuuuguuggaaagaucgugggcaugcucucgcagaccaccagagaaaacagcucaacgcgagcccacaaggccacggugagcacuggggacgcccacuucaugccaaagcuaggcaguguuuuguucaccacugacacugaagaucuccagaauggccagaacacaagauucaccccaguuggagucgcacaagauggcgaaccccaccagaaugagccacaacaauggcgacucccaaauuauucuggaacaccaggccauaaugugcacuuggcacccccagucgcccccaccuucccaggugaacaguugcucuucuucagaucuaccaugccuggguguggcggcuaccccaauauggauuuggauugccuacucccccaagaauggguacgccauuucuaucaagaggccgcaccagcacagucugauguagcccugcugagguuugugaauccagauacgggaagggugcuguuugagugcaagcuccacaaggcaggguacaucacagucucccacacuggucccuaugaucuggucaucccaccuaauggcuacuuuagauuugauuccugggucaaucaauuuuaugcacuugcccccaugggaacuggaacggggcgcaggcguuaa

SEQ ID NO: 8335 - RNA, 1614 nt, Artificial Sequence
  VP1__Norovirus_and/or_Norovirus-like__AF427116
augaagauggcgucgaaugacgccaacccaucugauggguccacagccaaccucgucccagaggucaacaaugagguuauggcuuuggagcccguuguuggugccgcuauugcagcaccuguagcgggccaacaaaauguaauugaccccuggauuagaaauaauuuuguacaagccccugguggagaguuuacaguauccccuagaaacgcuccgggugagauacuauggagcgcgccccugggcccugauuugaaccccuaccuuucucauuuggccagaauguacaaugguuaugcaggugguuuugaagugcagguaauccucgcggggaacgcguucaccgccgggaagaucauauuugcagcagucccaccaaauuuuccaacugaaggcuugagccccagccagguuacuauguucccccauauaauaguagauguuaggcaauuggaaccuguguugauuccuuuaccugauguuaggaacaauuucuaccauuauaaucaaucaaaugauucuaccauuaaauugauagcaaugcuguauacaccacuuagggcuaacaaugcuggggaugaugucuucacagucucuugucgaguccucacgaggccaucccccgauuuugauuucauauucuuggugccacccacaguugaaucaagaacuaaaccauucaccaucccaaucuuaacuguugaggaaauguccaauucaagauuccccauuccuuuggaaaaguuguauacgggucccagcagugcuuuuguuguccaaccacaaaauggcaggugcacgacugauggcgugcuccuaggcacuacccagcugucugcugucaacaucugcacuuucagagggaaugucauccacauugcaggcagucaugauuauacaaugaauuuggcuucucaaaauuggaacaauuaugacccaacagaagaaaccccagccccucugggaacuucagauuucgugggaaagauccaaggcuugcucacccaaaccacaagagaggauggcucgacccgcgcccacaaagcuacaguuagcacugggaguguccacuuuacuccaaagcuggguaguguucaguacaccacugacacaaacaaugauuuucaaacuggccaaaacacgaaauucaccccagucggcgucauccaggacgguaauaaccaucaaaaugaaccucaacaauggguacucccaaauuacucaggcagggcuggacauaaugugcaccuagcuccugccguugcccccacuuuuccgggugagcaacuucuuuucuuuagguccacuaugcccggauguagcggguaucccaacaugaaucuggauugccuacucccccaggaaugggugcagcacuucuaccaggaagcagcuccagcacaaucugauguggcucugcugagauuugugaacccagauacagguaggguuuuguuugaguguaagcuccauaaaucaggcuaugucacaguggcucacacuggcccgcaugauuugguuaucccccccaaugguuacuuuagauuugauuccugggucaaucaauuuuacacacuugcccccaugggaaauggagcggggcguagacguuaa

SEQ ID NO: 8336 - RNA, 1614 nt, Artificial Sequence
  VP1__Norovirus_and/or_Norovirus-like__KX514337
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuggguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucacuauaaucagucaaaugauucuaccauuaaauugauagcaaugcuguauacaccacuuagggccaauaaugcuggggaugaugucuucacagucucuugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcaggugcacgauugauggcgagcucuuaggcaccacccaacugucuucuguuaacauuugcaccuucagaggggauguuacucaaauuggggcaacucgucauuggacaaugaauuuggccucuccaaauuggaacaauuaugacccaacagaagaaacuccagccccccugggaacuccagauuuugugggaaagguccaugguaugcucacccaaaccacacagggaaguggcucgacccgggcccauagagcaacaguuuauguugggggugccgaauucacuccaaagcugggcaaaguucgauuugaaacugauacagaagaugaucuuguaauucgccaaaacacaaaauucaccccagucggugucauccagucaagugaacaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugagugcaaacuucauaaaucagguuaugucacaguggcucacaccggucaacaugauuuggucauccccccuaauggcuacuuuagguuugauuccuggguuaaucaauucuacacacuugcccccaugggaaauggaacggggcguaagcguuaa

SEQ ID NO: 8337 - RNA, 1614 nt, Artificial Sequence
  VP1__Norovirus_and/or_Norovirus-like__KX514255
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcagguaauccucgcggggaaugcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggagugccgauuucacuccaaagcugggcaaaguucaauuugaaacugaaacagacuaugaucuugcaauucgccaaaacacaaaauucaccccagucggugucauccaggaaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8338 - RNA, 1614 nt, Artificial Sequence
  VP1__Norovirus_and/or_Norovirus-like__KX514210
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguaucuccuagaaacgcuccaggugaaauacuauggagcgcgcccuuaggcccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauucucugucccaauccuaacuguuggagaaaugaccaauucaagauuucccguaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucaauuuaaaacugaaacagaccaugaucuuucaacucgccaaaacacaaaauucaccccagucggugucauccaggaaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggccaauaugauuugguccuccccucuaaugguuauuuuagguuugauuccugggucaaucaauucuacacacuugcccccaugggaaauggaacggggcguaggcguuaa

SEQ ID NO: 8339 - RNA, 1614 nt, Artificial Sequence
  VP1__Norovirus_and/or_Norovirus-like__KX514182
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguauccccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcagaugcacgauugauggcgagcucuuaggcaccacccaacugucuucuguuaacauuugcaccuucagaggggacguuacucacauugggacaacucaacauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucgauuugaaacugauacagaagaugaucuuguaauucgccaaaacacaaaauucaccccagucggugucauccagucaagugaacaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaagcguuaa

SEQ ID NO: 8340 - RNA, 1614 nt, Artificial Sequence
  VP1__Norovirus_and/or_Norovirus-like__AF425764
augaagauggcgucgaaugacgccaacccaucugauggguccacagccaaccucgucccagaggucaacaaugagguuauggcuuuggagcccgucguuggugccgcuauugcggcaccuguagcgggccaacaaaauguaauugaccccuggauuagaaauaauuuuguacaagccccugguggaggguuuacaguauccccuagaaacgcuccgggugagauacuauggagcgcgcccuugggcccugauuugaaccccuaccuuucucauuuggccagaauguauaauggcuaugcaggugguuuugaagugcagguaauucucgcggggagcgcguccaccgccgggaaaaucauauuugcagcagucccaccaaauuuuccaacugaaggcuugagccccagccaggucacuauguucccccauauaauaguagauguuaggcaacuggaaccuguguugauccccuuaccugauguuaggaauaauuucuaccauuauaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcuccuaggcacuacccagcugucugcugucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaauucaccccagucggcgucauccaggauggcaauaaccaucaaaaugaaccccaacaauggguacucccaaauuacucagguagaacuggucacaaugugcaucuagcuccugccguugcccccacuuuuccgggugagcaacuucuuuucuucagauccacuaugcccggauguagcggguaucccaacaugaaucuggauugucuacucccccaggaaugggugcagcacuucuaccaagaagcagcuccagcacaaucugauguggcucugcugagauuugugaauccagauacagguaggguucuguuugagugcaagcuccauaaaucaggcuaugucacaguggcucacacuggcccgcaugacuugguuaucccccccaaugguuacuuuagauuugacuccugggucaaccaguucuacacacuugcccccaugggaaauggagcggggcguagacguuaa

SEQ ID NO: 8341 - RNA, 1614 nt, Artificial Sequence
  VP1__Norovirus_and/or_Norovirus-like__KX514355
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccgccaacuuucccaacugaaggcuugagucccagucagguuaccauguucccccauauaauaguagauguuaggcaauuggaaccuguguugauccccuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauugggucaacucaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggggugccaauuucacuccaaagcugggcaaaguucaauuugaaacugauacaagcgaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuagauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8342 - RNA, 1614 nt, Artificial Sequence
  VP1__Norovirus_and/or_Norovirus-like__KX514345
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguacacaccacuuagggccaauaaugcuggggaugaugucuucacagucuccugucgaguccucacgaggccauccccugauuuugacuucauauuccuggugccaccuacaguugagucaaggucuaagcccuuuucugucccagucuuaacuguugaagaaaugaccaauucaagauuccccguaaauuuggaaagauuauucacgggacccagcagugccaauguuguucaaccacaaaauggcaggugcacgauugauggcgagcuuuuaggcaccacccaacugucuucuguuaacauuugcaccuucagaggggacguuacucaaauuggggcaacucgucauuggacaaugaauuuggccucucuaaauuggaacaauuaugacccaacagaagaaacuccagccccccugggaacuccagauuuugugggaaagauccaugguaugcucacccaaaccacacagggaaguggcucgacccgggcccauagagcaacaguuuauguuggggcugccgaauucacuccaaaacugggcaaaguucgauuugaaacugauacagaagaugaucuuguaauucgccaaaacacaaaauucaccccagucggugucauccagucaagugaacaccaccgagaugaaccccaacaauggagacucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucauaccggucaauaugauuugguccuccccucuaaugguuauuuuagguuugauuccugggucaaucaauucuacacacuugcccccaugggaaauggaacggggcguaggcguuaa

SEQ ID NO: 8343 - RNA, 1614 nt, Artificial Sequence
  VP1__Norovirus_and/or_Norovirus-like__KX514204
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacuguaucuccuagaaacgcuccaggugaaauacuauggagcgcgcccuuagguccugaccugaaucccuaccuaucucauuuggccagaauguauaaugguuaugcaggugguuuugaaguacaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggggugccgaauucacuccaaagcugggcaaaguucaauuuaaaacugaaacagaccaugaucuuucaauucgccaaaacacaaaauucaccccagucggugucauccaggaaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggccaauaugauuugguccuccccucuaaugguuauuuuagguuugauuccugggucaaucaauucuacacacuugcccccaugggaaauggaacggggcguaggcguuaa

SEQ ID NO: 8344 - RNA, 1614 nt, Artificial Sequence
  VP1__Norovirus_and/or_Norovirus-like__KF712492
augaagauggcgucgagugacgccaacccaucugauggguccacagccaaccucgucccagaggccaacaaugagguuauggcuuuggagcccguuguuggugccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuaggcccugaucuaaaccccuaucuaucucauuuguccagaauguauaaugguuaugcaggugguuuugaagugcagguaauccucgcggggaacgcguucgccgccggaaaaaucauauucgcagcagucccaccaaauuucccaacugaaggcuugagccccagccaggucacuauguucccccacuuaauaguagauguuaggcaacuggaaccugugaugauccccuuacccgauauuaggaauaauuucuaucauuacaaucaaucaaaugaucccaccaucaaauugauagcaauguuguauacaccucuuagggcuaauaauguuggugacgaugucuucacaguuucuugucggguacucacgagaccaucccccgauuuugauuucauauuucuagugccacccacaguugaaucaaaaaccaacccauucucuguuccaauucuaacuauugaggagaugaccaauucaagauuccccauuccuuuggaaaagcuguucacgggccccagcagugcccuuguuguucaaccacaaaacggcaggugcacgacugauggcgugcuccuggguaccacccaacugucuccugucaacaucugcaccuucagaggggaugucacccauacuacaaaaacucauaccuaccaaaugaauuuggcugcucaaaauuggaacaguuaugacccaacagaagaaaucccagccccccuaggaacuccagauuucgugggaaagauccaaggugugcucacccaaaccacgaagggaaauggcucaacccgugcccacaaagcuacaguguacacugggagcgccgaguucacuccaaaacuggguagaauccaacuuuucacugacacagacaacgaucuugaagcuaaccaaaacacaaaguucaccccagucggugucauccaggauggugauacccaccaaaaugaaccccaacaauggguacucccaaguuacucagguagaaauaaucacaaugugcaccuggcccccgcuguagcccccacuuuuccgggcgagcaacuucucuucuucagauccacuaugcccggaugcagcggguaccccaacaugaauuuggacugucugcuuccccaggaaugggugcaauauuucuaucaagaggcagccccagcacaaucugauguggcuuugcuaagauuugugaauccagauacagguaggguuuuguuugagugcaagcuucauaaaucagguuaugucacaguggcucacaccggccaccaugauuuguuuauccccccuaaugguuauuucagauuugauuccugggucagccccuucuacacacuugcccccaugggaaauggaacggggcguagacguuaa

SEQ ID NO: 8345 - RNA, 1614 nt, Artificial Sequence
  VP1__Norovirus_and/or_Norovirus-like__DQ078829
augaagauggcgucgaaugacgccaacccaucugauggguccgcagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggugagauauuauggagcgcgcccuugggcccugauuugaaccccuacccuucucauuuggccagaauguacaaugguuaugcgggugguuuugaagugcaaguaauccucgcggggaaugcguucaccgccgggaaaaucauauuugcagcagucccaccaaauuuuccaacugaaggcuugagccccagccagguuacuauguucccccauauaauaguagauguuaggcaauuggauccuguguugauccccucaccugauguuaggaauaacuucuaucauuacaaucaaucaaaugauucuaccauuaaauugauagcaaugcuguauacaccacuuagggcuaauaaugcuggggaugaugucuucacagucucuugucgaguccucacgaggccaucccccgauuuugauuucauauucuuggugccacccacaguugaaucaagaacuaaaccauucaccgucccaaucuuaacuguugaggaaaugucuaacucaagauuccccauuccuuuggaaaaguuguacacgggucccagcagugcuuuuguuguccaaccacaaaauggcaggugcacgacugauggcgugcucuuaggcacuacccagcugucugcugucaacaucugcaccuucagaggggaugucacccacauugcagguagucaugacuauacaaugaauuuggcuucucaaaauuggaucaauuaugacccaacagaagaaaucccagccccucugggaacuccagauuucgugggaaagauccaaggcaugcucacccaaaccacaagggaggacggcucgacccgcgcccacaaagcuacagugagcacugggaguguccacuucacuccaaagcugggcaguguucaauacaccacugacacaaacaaugacuuucaaacuggccaagacacgaaauucaccccggucggcgucauccaggacgguaauaaucaucaaaaugaaccccaacaaugggugcucccaaauuacucagguagaacaggucauaaugugcaccuagcuccugccguugcccccacuuucccgggcgagcaacuucuuuucuucagguccacuaugcccggauguagcggguauccuaacaugaaucuggauugccuacuuccccaagaaugggugcaacacuucuaccaagaagcagcuccagcacaaccugauguggcucugcugagauuugugaauccagacacagguaggguuuuguuugagugcaagcuccauaaaucaggcuaugucacaguggcucacacuggcccgcaugauuugguuaucccccccaaugguuauuuuagauuugacuccugggucaaccaguucuacacacuugcccccaugggaaauggagcggggcgcagacguuaa

SEQ ID NO: 8346 - RNA, 1614 nt, Artificial Sequence
  VP1__Norovirus_and/or_Norovirus-like__KX514370
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaauucaccguauccccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauucuaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauuggggcaacucgucauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggggugccgaauucacuccaaagcugggcaaaguucgauuugaaacugauacagaagaugaucuuguaauucgccaaaacacaaaauucaccccagucggugucauccagucaagugaacaccaccgagaugaaccccaacaauggaggcucccaaauuauucaggugcaaauacuuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8347 - RNA, 1614 nt, Artificial Sequence
  VP1__Norovirus_and/or_Norovirus-like__KX514332
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguauacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauugggucaacuaaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggggugccaauuucacuccaaagcugggcaaaguucaauuugaaacugauacagucgaugaucuugaaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8348 - RNA, 1614 nt, Artificial Sequence
  VP1__Norovirus_and/or_Norovirus-like__KX514276
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguauccccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggacaacucaucauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucgauuugaaacugauacagaagaugaucuuguaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccuggguuaaucaauucuacacacuugcccccaugggaaauggaacggggcguaggcguuaa

SEQ ID NO: 8349 - RNA, 1614 nt, Artificial Sequence
  VP1__Norovirus_and/or_Norovirus-like__KX514256
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaagauuauauuugcagcagucccaccaacuuucccaacugagggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaauuuggaaggauuauucacaggacccagcagugccaauguuguucaaccacaaaauggcaggugcacgauugauggcgagcucuuaggcaccacccaacugucuucuguuaacauuugcaccuucagaggggacguuacucacauugggucaacucaccacuggacaaugaauuuggccucuccaaauuggaacagcuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucaauuuaaaacugaaacaaaccaugaucuuucaauucgccaaaacacaaaauucaccccagucggugucauccaggaaagugaucaccaccgagaugaaccccaacaauggaggcucccaaauuauucaggugcaaauaccuuuaaugugcaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguagcucuauugagauuugugaauccagacacgaguaggguccuguuugaauguaaacuucauaaaucaggcuacgucacaguggcucacaccggccaauaugauuugguccuccccccuaaugguuauuuuagguuugauuccugggucaaucaauucuacacacuugcccccaugggaaauggaacggggcguaggcguuaa

SEQ ID NO: 8350 - RNA, 1614 nt, Artificial Sequence
  VP1__Norovirus_and/or_Norovirus-like__KX514209
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuaauauuucuggugccaccuacaguugagucaagaacuaaaccauuuucugucccaauccuaacuguuggagaaaugaccaauucaagauuucccguaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucaauuuaaaacugaaacagaccaugaccuuucaauucgccaaaacacaaaauucaccccagucggugucauccaggaaagugaucaccaccgagaugaaccccaacaauggaggcucccaaauuauucaggugcaaauaccuucaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggccaauaugauuugguccuccccucuaaugguuauuuuagguuugauuccugggucaaucaauucuacacacuugcccccaugggaaauggaacggggcguaggcguuaa

SEQ ID NO: 8351 - RNA, 1614 nt, Artificial Sequence
  VP1__Norovirus_and/or_Norovirus-like__KX514205
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguauacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggggugccgaauucacuccaaagcugggcaaaguucaauuuaaaacugaaacagaccaugaucuuucaauucgccaaaacacaaaauucaccccagucggugucauccaggaaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggcgggcaucccaacauggauuuggauugccuacucccccaggagugggugcaacacuucuaccaagaggcagcuccagcacaaucugauguggcucuauugagauuugugaauccagacacaaguaggguccuguuugagugcaaacuucauaaaucagguuaugucacaguggcucacaccggucaacaugauuugguuaucccccccaauggcuacuuuagauuugauuccugggucaaucaauucuacacacuugcccccaugggaaauggaacggggcguaggcguuaa

SEQ ID NO: 8352 - RNA, 1614 nt, Artificial Sequence
  VP1__Norovirus_and/or_Norovirus-like__KX514200
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugacuaauucaagauuucccauaaauuuggaaagauuauucacgggacccagcagugccaauguuguucaaccacaaaauggcaggugcacgauugauggugagcucuuaggcaccacccaacugucuccuguuaacauuugcaccuucagaggggacguuacacacauugggacaacucgccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucaauuuaaaacugaaacagaccaugaucuuucaauucgccaaaacacaaaauucaccccagucggugucauccaaaaaagugaucaccaccgagaugaaccccaacaauggaggcucccaaauuauucaggugcaaauaccuuuaauguacaccuagccccugcuguagcccccaauuuccccggcgaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggccaauaugauuugguccuccccucuaaugguuauuuuagguuugauuccugggucaaucaauucuacacacuugcccccaugggaaauggaacggggcguaggcguuaa

SEQ ID NO: 8353 - RNA, 1614 nt, Artificial Sequence
  VP1__Norovirus_and/or_Norovirus-like__KX514196
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacguguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggggugccgaauucacuccaaagcugggcaaaguucaauuuaaaacugaaacagaccaugaucuuacaauucgccaaaacacaaaauucaccccagucggugucauccaggaaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggccaauaugauuugguccuccccucuaaugguuauuuuagguuugauuccugggucaaucaauucuacacacuugcccccaugggaaauggaacggggcguaggcguuaa

SEQ ID NO: 8354 - RNA, 1614 nt, Artificial Sequence
  VP1__Norovirus_and/or_Norovirus-like__AB985437
augaagauggcgucgaaugacgccaacccaucugauggguccgcagccaaccucgucccagaggucaacaaugagguuauggcucuggagcccguuguuggugccgccauugcggcaccuguggcgggccaacaaaauguaauugaccccuggauuagaaauaauuuuguacaagccccuggcggagaguucacaguguccccuagaaacgcuccaggugaaauacuauggagcgcgccccugggcccugauuuaaaucccuaucuuucucauuugucuagaauguacaaugguuaugcaggugguuuugaagugcaaguaauccucgcggggaacgcguucacugccgggaaagucauauuugcagcaguuccaccaaacuuuccaacugaaggucuaagccccagccagguuacuauguucccccauauaauuguagauguuaggcaauuggaacccgugcugaucccccugccugauguuaggaauaauuuuuaccauuacaaucaagcacaugauucuacccucaaguugauagcaauguuguacacaccacuuagagcuaauaaugccggggaugaugucuuuacagucucuugucgaguucucacgaggccaucccccgauuuugacuuuauauuccuggugccacccacaguugaaucaagaacuaaaccauucacugucccaaucuuaacuguugaggaaaugucuaauucaagauuccccauuccuuuggaaaagcuauacacggguccuagcagugccuuuguuguccaaccacaaaauggcagauguacgacugaugggguacucuuaggcaccacccagcugucagcugucaauaucuguaacuuuaggggggaugucacccauauuguggguagccaugacuauacaaugaauuugguaucccaaaauuggaauaauuaugacccaacagaagaaaucccagcuccccugggaacgccagacuuugugggaaagauccaaggcuugcucacccagaccacaagagcggauggcucgacccgcgcccacaaagcuacagugagcacugggaguguccacuucacuccaaagcuggguaguguucaauucaccacugauacaaauaaugauuuccaaacuggccaaaacacaaaauucaccccaguuggcgucauucaagacggugaucaccaucagaaugaaccccaacaauggguacucccaaacuacucaggcacaucuggucauaauguacaucuggccccugccguugcccccacuuucccgggugagcagcuucuuuucuuuagauccacuaugcccggauguagcggguaucccaacaugaaucuggauugccugcucccccaggagugggugcugcacuuuuaccaggaagcagccccagcacaauccgauguggcccugcugagauuugugaauccagauacagguaggguccuguuugagugcaaacuccauaaaucaaguuacaucacaguggcucacacuggcccguaugauuugguuauuccccccaaugguuauuuuagguuugauucuugggucaaucacuucuacacacucgcccccaugggaaauggaacggggggcaggcguuaa

SEQ ID NO: 8355 - RNA, 1614 nt, Artificial Sequence
  VP1__Norovirus_and/or_Norovirus-like__KF712494
augaagauggcgucgagugacgccaacccaucugauggguccacagccaaccucgucccagaggccaacaaugagguuauggcuuuggagcccguuguuggugccgccauugcggcgccuguagcgggccaacaaaauguaauugaccccuggauuagaaacaauuuugugcaagccccugguggagaauuuacaguauccccuagaaacgcuccaggugaaguacuauggagcgcgcccuuaggcccugauuugaaucccuaccuuucucauuuggccagaauguacaaugguuaugcaggugguuuugaagugcagguaauccucgcggggaacgcguucgccgccggaaaaaucauauucgcagcagucccaccaaauuucccaacugaaggcuugagccccagccaggucacuauguucccccacuuaauaauagauguuaggcaacuggaaccugugaugauccccuuacccgauguuaggaauaauuucuaucauuacaaucaaucaaaugaucccaccaucaaauugauagcaauguuguauacaccucuuagggcuaauaauguuggugacgaugucuucacaguuucuugucggguacucacgagaccaucccccgauuuugauuucauauuucuagugccacccacaguugaaucaaaaaccaacccauucucuguuccaauuuuaacuauugaggagaugaccaauucaagauuccccauuccuuuggaaaagcuguucacgggccccagcagugcccuuguuguucaaccacaaaacggcaggugcacgacugauggcgugcuccuagguaccacccaacugucuccugucaacaucugcaccuucagaggggaugucacccauauuacaaaaacucauagcuaccaaaugaauuuggcugcucaaaauuggaacaguuaugacccaacagaagaaaucccagccccccuaggaacuccagauuucgugggaaagauccaaggugugcucacccaaaccacgaagggaaauggcucaacccgugcccacaaagcuacaguguacacugggagcaccgaauucacuccaaaacuggguagaauccaacuugucacugacacagacaacgaucuugaaacuaaccaaaacacaaaguucaccccagucggugucauccaggauggugauacccaccaaaaugaaccccaacaauggguacucccaaguuacuuagguagaaauaaucacaaugugcaccuggcccccgcuguagcccccacuuuuccgggcgagcaacuucucuucuucagauccacuaugcccggaugcagcggguaccccaacaugaauuuggacugucugcuuccccaggaaugggugcaauauuucuaucaagaggcagccccagcacaaucugauguggcuuugcuaagauuugugaauccagauacagguaggguuuuguuugagugcaagcuucauaaaucagguuaugucacaguggcucacaccggccaccaugauuuguuuaucccccccaaugguuauuucagauuugauuccugggucagccccuucuacacacuugcccccaugggaaauggaacggggcguagacguuaa

SEQ ID NO: 8356 - RNA, 1614 nt, Artificial Sequence
  VP1__Norovirus_and/or_Norovirus-like__KX514315
augaagauggcgucgagugacgccaacccaucugauggguccacagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauugggucaacuaaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggggugccaauuucacuccaaagcugggcaaaguucaauuugaaacugauacaggcgaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcccacaccggucaauaugauuugguccuccccucuaaugguuauuuuagguuugauuccugggucaaucaauucuacacacuugcccccaugggaaauggaacggggcguaggcguuaa

SEQ ID NO: 8357 - RNA, 1614 nt, Artificial Sequence
  VP1__Norovirus_and/or_Norovirus-like__KX514199
augaagauggcgucgagugacgccaacccaucugauggguccgcagccaaccucgucccagaggucaacaaugagguuauggcuuuggagcccguugucggugccgcuauuguggcgccuguagcgggccaacaaaauguaauugaccccuggauuagaaauaauuuuguucaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugauuuuauauuucuggugccaccuacaguugagucaagaacuaaaccauuuucugucccaauccuaacuguuggagaaaugaccaauucaagauuucccauaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucaauuuaaaacugaaacagaccaugaucuuacaauucgccaaaacacaaaauucaccccagucggugucauccaggaaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcugcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8358 - RNA, 1614 nt, Artificial Sequence
  VP1__Norovirus_and/or_Norovirus-like__KX514176
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguauccccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucgcauugggacaacucaacauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucgauuugaaacugauacagaagaugaucuuguaauucgccaaaacacaaaauucaccccagucggugucauccagucaagugaacaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8359 - RNA, 1614 nt, Artificial Sequence
  VP1__Norovirus_and/or_Norovirus-like__KX514360
augaagauggcgucgagugacgccaacccaucugauggguccacagccaaccucgucccagaggucaacaaugagguuauggcuuuggagcccguugucggcgccgcuauugcggcgccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuuguaccuucagaggggacguuacucaaauugggucaacuaaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggggugccaauuucacuccaaagcugggcaaaguucaauuugaaacugauacaggcgaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8360 - RNA, 1614 nt, Artificial Sequence
  VP1__Norovirus_and/or_Norovirus-like__KX514347
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguucaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguggauguuaggcaauuagaaccuguguugauccccuuaccugauguuaggaauaacuucuaucauuauaaucagucaaaugauucuaccauuaaauugauagcaaugcuguacacaccacuuagggccaauaaugcuggggaugaugucuucacagucuccugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccaaucugggaacacuaaaauuuacacaaugaauuuggccucuccaaauuggaacaauuaugacccaacagaagagauuccagccccucugggaacuccagauuuugugggaaagauccaugguaugcucacccaaaccacacagggaaguggcucgacccgggcccauagagcaacaguuuauguugggggugccgaauucacuccaaagcugggcaaaguucgauuugaaacugauacagaagaugaucuuguaauucgccaaaacacaaaauucaccccagucggugucauccagucaagugaacaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuugguccuccccucuaaugguuacuuuagguuugauuccugggucaaucaauucuacacacuugcccccaugggaaauggaacggggcguaggcguuaa

SEQ ID NO: 8361 - RNA, 1614 nt, Artificial Sequence
  VP1__Norovirus_and/or_Norovirus-like__AB684675
augaagauggcgucgagugacgccaacccaucugauggguccgcagccaaccucgucccagaggucaacaaugagguuauggcuuuggagccuguuguuggugccgccauugcagcaccuguggcaggccaacaaaauauaauugaccccuggauuagaaauaauuuuguacaagccccugguggagaguuuacaguguccccuagaaacgcuccaggugagauacuauggagcgcgcccuugggcccugauuugaaccccuaucuuucucaccuguccagaauguacaaugguuaugcaggugguuuugaagugcaagugauccucgcagggaacgcguucaccgccgggaaagucauauuugcagcaguuccaccaaauuuuccaacugaaggucuaagccccagucagguuacuauguucccccauauaauuguagauguuaggcaauuggaaccuguauugaucccccuaccugauguuaggaauaauuucuaucauuauaaucaagcacaugauucuacccucaaauugauagcaauguuguacacaccacucagagcuaauaaugccggagaugaugucuuuacaguuucuugucgaguccucacgagaccaucccccgauuuugauuuuauauuccuggugccacccacaguugaaucaagaacuaaaccauuuacugucccaaucuuaacuguugaggaaauguccaauucaagauuccccauuccuuuggaaaagcuguacacggguccuagcagugcuuuuguuguccaaccacaaaauggcagaugcacgacugauggcgugcucuuaggcacuacucagcugucagcugucaauaucugcaacuucuugggggaugucacccguguugggaccagccaugauuauacaaugaauuuagugucccaaaauugggacaauuaugauccaacagaagaaauuccagcuccccugggaacacccgacuuugugggaaaaauacaagguuugcucacccaaaccacaagagcggacaggucgacccccgcccacaaagcuacagugagcacugggaguguccacuucacuccaaagcuggguaguguucaauucaccacugauacgaacaaugauuuccaaacuggccaaaacacaaaauuuaccccaguuggugucauccaagacagugaucaccaucagaaugaaccccaacaauggguacucccaaauuacucagguacaacuggucacaaugugcaucuggccccugcuguugcccccacuuucccgggugagcagcuucuuuucuuuagggucacuaugcccggguguagcggguaccccaacaugaauuuggacugccugcucccccaggagugggugcugcacuuuuaccaggaagcagccccagcacaauccgauguggcccugcugagauuugugaauccagacacagguaggguucuguuugagugcaaacuccauaagucaggcuauaucacaguggcucauacuggcccguaugauuugguuaucccccccaaugguuacuucagauuugauucuugggucaaccaguucuacacacucgcccccaugggaaauggaacggggcgcaggcguuaa

SEQ ID NO: 8362 - RNA, 1614 nt, Artificial Sequence
  VP1__Norovirus_and/or_Norovirus-like__KX514369
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguauccccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauucuaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauuggggcaacucgucauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggggugccgaauucacuccaaagcugggcaaaguucgauuugaaacugauacagaagaugaucuuguaauucgccaaaacacaaaauucaccccagucggugucauccagucaagugaacaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcgcaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8363 - RNA, 1614 nt, Artificial Sequence
  VP1__Norovirus_and/or_Norovirus-like__KX514310
augaagauggcgucgaaugacaccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagucaggucaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggccaauaaugcuggggaugaugucuucacagucuccugucgaguccucacgaggccauccccugauuuugacuuuauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuaaaauuuacacaaugaauuuggccucuccaaauuggaacaauuaugacccaacagaagagauuccagccccucugggaacuccagauuuugugggaaagauccaugguaugcucacccaaaccacacaggaaaauggcucgacccgggcccauagagcaacaguuuauguugggggugccaauuucacuccaaagcugggcaaaguucaauuugaaacugauacaggcgaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugaauguaaacuccauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8364 - RNA, 1614 nt, Artificial Sequence
  VP1__Norovirus_and/or_Norovirus-like__KX514185
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguauccccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcaggugcacgauugauggcgggcucuuaggcaccacccaacugucuucuguuaacauuugcaccuucagaggggacguuacucacauugggacaacucgucauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucgauuugaaacugauacagaagaugaucuuguaauucgccaaaacacaaaauucaccccagucggugucauccagucaagugaacaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguucuccccucuaaugguuauuuuagguuugauuccugggucaaucaauucuacacacuugcccccaugggaaauggaacggggcguaggcguuaa

SEQ ID NO: 8365 - RNA, 1614 nt, Artificial Sequence
  VP1__Norovirus_and/or_Norovirus-like__KX514181
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguauccccuagaaacgcuccaggugaaauacuauggagcgcgcccuuagguccugaccugaaucccuaccuaucucauuuggccagaauguauaaugguuaugcaggugguuuugaaguacaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaacaauuuucugucccaauccuaacuguuggagaaaugaccaauucaagauuccccguaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggacaacucgucauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucgauuugaaacugauacagaagaugaucuuguaauucgccaaaacacaaaauucaccccagucggugucauccagucaagugaacaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8366 - RNA, 1614 nt, Artificial Sequence
  VP1__Norovirus_and/or_Norovirus-like__KF712493
augaagauggcgucgagugacgccaacccaucugauggguccacagccaaccucgucccagaggccaacaaugagguuauggcuuuggagcccguuguuggugccgccauugcggcgccuguagcgggccaacaaaauguaauugaccccuggauuagaaacaauuuugugcaagccccugguggagaguuuacaguauccccuagaaacgcuccaggugaaguacuauggagcgcgcccuuaggcccugauuugaaucccuaccuuucccauuuggccagaauguacaaugguuaugcaggugguuuugaagugcagguaauccucgcggggaacgcguucgccgccggaaaaaucauauucgcagcagucccaccaaauuucccaacugaaggcuugagccccagccaggucacuauguucccccacuuaauaguagauguuaggcaacuggaaccugugaugauccccuuacccgauauuaggaauaauuucuaucauuauaaucaaucaaaugaucccaccaucaaauugauagcaauguuguauacaccucuuagggcuaauaauguuggugacgaugucuucacaguuucuugucggguacucacgagaccaucccccgauuuugauuucauauuucuagugccacccacaguugaaucaaaaaccaacccauucucuguuccaauucuaacuauugaggagaugaccaauucaagauuccccauuccuuuggaaaagcuguucacgggccccagcagugcccuuguuguucaaccacaaaacggcaggugcacgacugauggcgugcuccuggguaccacccaacugucuccugucaacaucugcaccuucagaggggaugucacccauacuacaaaaacucauaccuaccaaaugaauuuggcugcucaaaauuggaacaguuaugacccaacagaagaaaucccagccccccuaggaacuccagauuucgugggaaagauccaaggugugcucacccaaaccacgaagggaaauggcucaacccgugcccacaaagcuacaguguacacugggggcgucgaguucacuccaaaacuggguagaauccaacuuuucacugacacagacaacgaucuugaagcuaaccaaaacacaaaguucaccccagucggugucauccaggauggugauacccaccaaaaugaaccccaacaauggguacucccaaguuacucagguagaaauaaucacaaugugcaccuggcccccgcuguagcccccacuuuuccgggcgagcaacuucucuucuucagauccacuaugcccggaugcagcggguaccccaacaugaauuuggacugucugcuuccccaggaaugggugcaauauuucuaucaagaggcagccccagcacaaucugauguggcuuugcuaagauuugugaauccagauacagguaggguuuuguuugagugcaagcuucauaaaucagguuaugucacaguggcucacaccggccaccaugauuuguuuauccccccuaaugguuauuucagauuugauuccugggucagccccuucuacacacuugcccccaugggaaauggaacggggcguagacguuaa

SEQ ID NO: 8367 - RNA, 1614 nt, Artificial Sequence
  VP1__Norovirus_and/or_Norovirus-like__FJ411169
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauucccuuaccugauguuaggaacaauuucuaucauuacaaucaaucaaaugauuccaccauuaaauugauagcaaugcuguauacaccacuuagggcuaauaaugcuggggcagacgucuucacagucucucgucgaguccucacgaggccaucccccgauuuugauuucauauucucggugccacccacaguugaaucaagaacuaaaccauucaccgucccaaucuuaacuguugaggaaauguccaauucaagauuccccauuccuuuggaaaaguuguacacgggucccagcagugcuuuuguuguccaaccacaaaauggcaggugcacgacugauggcgugcucuuaggcaccacccagcugucugccgucaacaucugcaccuucagaggggaugucacccacauugcaggcagucaugauuauacaaugaauuuggcuucucaaaauuggaacaauuaugacccaacagaagaaaucccagccccucugggaacuccagauuucgugggaaagauccaaggcaugcucacccaaaccacaagagaggauggcucgacccgcgcccacaaagcuacagugaguacugggaguguccacuuuacuccaaagcugggcaguguucaguacaccacugacacaaacaaugauuuucaaacuggccaaaacacgaaauucaccccagucggcgucauccaggacgguaauaaccaucaaaaugaaccccaacaauggguacucccaaauuacucaggcagaacuggucauaaugugcaccuagcuccugccguugcucccacuuuuccgggugagcaacuucuuuucuuuagguccacuaugcccggauguagcggguaucccaacaugaaccuggauugccuacucccccaggaaugggugcagcacuucuaccaagaagcagcuccagcacaaucugauguagcucugcugagauuugugaauccagauacagguaggguucuguuugagugcaagcuccauaaaucaggcuauguuacaguggcucacacuggcccgcaugauuugguuaucccccccaaugguuacuucagauuugauuccugggucaaccaguucuacacacuugcccccaugggaaauggagcggggcguagacguuaa

SEQ ID NO: 8368 - RNA, 1614 nt, Artificial Sequence
  VP1__Norovirus_and/or_Norovirus-like__AF427121
augaagauggcgucgaaugacgccaacccaucugauggguccacagccaaccucgucccagaggucaacaaugagguuaugacuuuggagcccguuguuggugccgcuauugcggcaccuguagcgggccaacaaaauguaauugaccccuggauuggaaauaauauuguacaagccccugguggagaguuuacaguauccccuagaaacgcuccgggugagauacuauggagcgcgcccuugggcccugauuugaaccccuaccuuucucauuuggccagaauguacaaugguuaugcaggugguuuugaagugcaagugauccucgcggggaacgcguucaccgccgggaaaaucauauuugcagcagucccaccaaauuuuccaacugaaggcuugagccccagccagguuacuguguucccccauauaauaguagauguuaggcaauuagagccuguguugauucccuuaccugaugucaggaauaauuuccaucauuauaaucaaucaaaugauucuaccauuaaauugauagcaaugcuguacacaccacuuagggcuaauaaugcuggggaugaugucuucacagucucuugucgaguccucacgaggccaucccccgauuuugauuucauauucuuggugccaccaacaauugaaucaagaacuaaaccauucaccgucccaaucuuaacuguugaggaaauguccaauucaagauuccccauuccuuuggaaaaguuguacacgggucccagcagugcuuuuguuguccaaccacagaacggcaggugcacgacugauggcgugcuccuaggcacuacccagcugucugcagucaacaucugcaccuucagaggggacgucacccacauugcaggcagucaugauuacacaaugaauuuggcuucucaaaauuggaacaauuaugacccaacagaagaaaucccagccccucugggaaccccagacuucgugggaaagauccaaggugugcucacccaaaccacaagagaggauggcucgacccgcgcccacaaagcuacagugagcacugggaguguccacuuuacuccaaagcugggcaguguucaauacaccacugauacaagcaaugauuuucaaacuggccaaaacacgaaauucaccccagucggcgucauccaggacgguaauaaccaucaaaaugaaccccaacaauggguacucccaaauuauucaggcagaacuggucauaaugugcaccuagcuccugccguugcccccacuuuuccgggugagcaacuccuuuucuuuagguccacuaugcccggauguagcggguaucccaacaugaaucuggauugccuacucccccaggaaugggugcagcacuucuaccaagaagcggcuccagcacaaucugauguggcucugcugagauuugugaauucagauacaggcaggguucuguuugaguguaagcuccauaaaucaggcuaugucacaguggcucacacuggcccgcaugauuugguuaucccccccaaugguuacuuuagauuugauuccugggucaaccaguucuacacacuugcccccaugggaaauggagcggggcguagacguuaa

SEQ ID NO: 8369 - RNA, 1614 nt, Artificial Sequence
  VP1__Norovirus_and/or_Norovirus-like__KF429787
augaagauggcgucgaaugacgcuaccccaucugauggguccucggccaaccucgucccagaggccaacaaugagguuauggcuuuagaacccguugcuggcgccgcgauugcggcaccuguagcgggccaacaaaauguaauugaccccuggauuagaaauaauuuuguacaagccccugguggagaguuuacaguauccccuagaaacgcuccaggugaaauacuauggagcgcguccuugggcccugauuugaaccccuaccuuucccacuugucuagaauguauaaugguuaugcagguaguuuugaagugcagguaauccucgcggggaacgcguucaccgcugggaaaaucauauuugcagcagucccaccaaauuuccgaacugaaggcuugagccccagccagaucaccauguucccccacauaauaacagauguuagacaauuggaaccuguguugauccccuugccugauauuaggaacaauuucuaccauuauaaucaaucaaaugaccccacuauuaaauugauagcaaugcuguauacgccacuuagggccaauaaugcuggggaugauguuuucacagucucuugccgaguucucacaaggccaucccccgauuuugauuucauauuucuggugccacccacaguugaaucaagaacuaaaccauucucugucccaguccuaacuguugaggagaugaccaacucaagauucccuauuccuuuggaaaaguuguucacgggcccuagcagugccuuuguuguucagccacaaaaugguagaugcacgacugauggcgugcucuuagguaccacccaacugucuccugucaacaucugcaccuucaggggggaugucacccgcauuggaaauucucgcgaguacagaaugaaccuggccucccuaaauuggaacaauuaugacccaacagaagaaaucccagccccccugggaaccccagauuuugcaggcaagauccaaggugugcucacccagaccacaaggcaugacgguucgacccgcggucacaaagccacgguguacacuggaagugccggauucaccccaaagcuaggcaguguucaauucuccacugacacagacaaugaccuugaggccaaccaaaacacgagguucaccccagucggugucauccaggacggcaacgcccaccaaggagaaccucagcaaugggugcucccaaacuaugcaggcagagauggucacaauguacaccuagccccugccguggcccccacuuucccgggugagcaacuucucuucuuuagguccaccaugcccggguguagcggguaucccaauaugaauuuggacugccuacucccccaggagugggugcagcacuucuaccaagagucagccccagcacaauccgacguggcauuacuuagauuugugaauccagacacagguaggguuuuguuugagugcaaacuucauaaaucaggcuacgugacaguggcucacacuggcccacaugauuuggucaucccccccaauggcuauuuuagauuugauuccugggucaaccaguucuacacacuugcccccaugggaaauggagcggggcguaggcguuaa

SEQ ID NO: 8370 - RNA, 1614 nt, Artificial Sequence
  VP1__Norovirus_and/or_Norovirus-like__AB933728
augaagauggcgucuaacgacgccaacccaucugauggguccgcagccaaccucgucccagaggucaacaaugagguuauggcuuuggagcccguuguuggugccgcuaucgcggcacccguagcgggccaacaaaauguaauugaccccuggauuaggaacaauuuuguacaagccccugguggagaguucacaguguccccuagaaacgcuccaggugaaauacuauggagcgcgcccuuaggcccugaucugaacccauaccuuucccaccuggccagaauguacaaugguuaugcagguggcuuugaagugcagguaauccuugcggggaacgcguucaccgcagguaaaaucauauuugcagcaaucccaccaaauuuuccaacugaaggcuugagccccagucaggucacuauguucccccauauaguaguagauguuaggcaauuggaaccuguauugauccccuuaccugauguuaggaacaauuucuaccacuacaaucaaacaaaagaguccaccaucaaauugguagcaaugcuguacacaccacuuagggcuaauaaugcuggggaugaugucuucacagucucuugucgaguccucacgagaccaucccccgauuuugauuucauauuucuggugccacccucaguugaaucaagaaccaaaccauucaccgucccaauuuuaacuguugaggaaaugaccaauucaagauuccccauaccuuuggaaagauuguucacggguccuagcagugccuuugucguccagccacaaaauggcaggugcacgacugauggcgugcucuuaggcaccacccaacugucccccgucaacaucugcaccuucagaggggacgucacccgaguuucaaccacucauguuuaugaaaugaauuuggcuucucaaaauuggaauaauuaugacccaacagaagaagucccagccccucugggaacuccagauuuugugggaaagauccaaggcgugcucacccaaaccacaaggacagacgguucgacccgcgcccacaaagcaacggugagcacuggggcugccgacuucacuccaaaacugggcagcauccgguucgaaaccaccacgaaccgugaucuugaaacucaccaaaacacaaaguucaccccagucggugucauccaggauggugacaaccaccaaaaugaaccccaacaauggagacucccagguuacgcagguagggaugcucacaacgugcaccuagccccugccguagcccccacuuucccgggugagcaacuccuuuucuucagauccaccaugcccggaugcaguggguaucccaacaugaauuuggauugucuacucccccaagaaugggugcagcacuucuaccaagaggcagccccagcacaaucugauguggcucuguugagauucgugaauccagacacggguagaguucuguuugagugcaagcuucacaaaucaggcuaucucacaguggcccacaccggcccguaugauuuggucaucccccccaauggcuacuucagauuugauucgugggucaaccaguucuacacucuugcccccaugggaaauggaacggggcguagacguuaa

SEQ ID NO: 8371 - RNA, 1614 nt, Artificial Sequence
  VP1__Norovirus_and/or_Norovirus-like__KX514346
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucaccguauccccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauucuaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcaggugcacgauugauggcgagcuuuuaggcaccacccaacugucuucuguuaacauuugcaccuucagaggggacguuacucaaauugggucaacuaaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgagcccauagagcaacaguuuauguuggggguuccaauuucacuccaaagcugggcaaaguuccauuugaaacugauacaggcgaugaucuugcaauucgccaaaacacaaaauucaccccagucggugucauccagucaaguggucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccucaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8372 - RNA, 1614 nt, Artificial Sequence
  VP1__Norovirus_and/or_Norovirus-like__KX514249
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaagauuauauuugcagcagucccaccaacuuucccaacugagggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaacccuggggaugaugucuucacagucuccugucgaguccucacgaggccauccccugauuuugaccuuauauuucuggugccaccuacaguugagucaagaacuaaaccauuuucugucccaauccuaacuguuggagaaaugaccaauucaagauuucccauaaauuuggaaggauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggggugccgaauucacuccaaagcugggcaaaguucaauuuaaaacugaaacaaaccaugaucuuucaauucgccaaaacacaaaauucaccccagucggugucauccaggaaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggccaauaugauuugguccuccccucuaaugguuauuuuagguuugauuccugggucaaucaguucuacacacuugcccccaugggaaauggaacggggcguaggcguuaa

SEQ ID NO: 8373 - RNA, 1614 nt, Artificial Sequence
  VP1__Norovirus_and/or_Norovirus-like__KF429760
augaagauggcgucgaaugacgcuaccccaucugauggguccucggccaaccucgucccagaggucaacaaugagguuauggcuuuagaacccguugcuggcgccgcgauugcggcaccuguagcgggccaacaaaauguaauugaccccuggauuagaaauaauuuuguacaagccccugguggagaguuuacaguauccccuagaaacgcuccaggugaaauacuauggagcgcguccuugggcccugauuugaaccccuaccuuucccacuugucuagaauguauaaugguuaugcagguaguuuugaagugcagguaauccucgcggggaacgcguucaccgcugggaaaaucauauuugcagcagucccaccaaauuuccgaacugaaggcuugagccccagccagaucaccauguucccccacauaauaacagauguuagacaauuggaaccuguguugauccccuugccugauauuaggaauaauuucuaccauuauaaucaaucaaaugaccccacuauuaaauugauagcaaugcuguauacaccacuuagggccaauaaugcuggggaugauguuuucacagucucuugccgaguucucacaaggccaucccccgauuuugauuucauauuucuggugccacccacaguugaaucaagaacuaaaccauucucugucccaguccuaacuguugaggagaugaccaacucaagauucccuauuccuuuggaaaaguuguucacgggcccuagcagugccuuuguuguucagccacaaaaugguagaugcacgaccgauggcgugcucuuagguaccacccaacugucuccugucaacaucugcaccuucaggggggaugucacccgcauuggaaauucucgcgaguacagaaugaaccuggccucccuaaauuggaacaauuaugacccaacagaagaaaucccagccccccugggaaccccagauuuugcagguaagauccaaggugugcucacccagaccacaaggcaugauggcucgacccgcggucacaaagccacgguguacacuggaagugccggauucaccccaaagcuaggcaguguucaauucuccacugacacagacaaugaccuugaggccaaccaaaacacgagguucaccccagucggugucauccaggacggcaacgcccaccaaggagaaccucagcaaugggugcucccaaacuaugcaggcagagauggucacaauguacaccuagccccugccguggcccccacuuucccgggugagcaacuucucuucuuuagguccaccaugcccggguguagcggguaucccaauaugaauuuggacugccuacucccccaggagugggugcagcacuucuaccaagagucagccccagcacaauccgauguggcauuacuuagauuugugaauccagacacagguaggguuuuguuugagugcaaacuucauaaaucaggcuacgugacaguggcucacacuggcccacaugauuugguuaucccccccaauggcuauuuuagauuugauuccugggucaaccaguucuacacacuugcccccaugggaaauggagcggggcguaggcguuaa

SEQ ID NO: 8374 - RNA, 1614 nt, Artificial Sequence
  VP1__Norovirus_and/or_Norovirus-like__AB303929
augaagauggcgucgaaugacgccaacccaucugauggguccgcagccaaccucgucccagaggucaacaaugagguuauggcucuggagcccguuguuggugccgccauugcggcaccuguagcgggccaacaaaacauaauugaccccuggauuagaaauaauuuuguacaagccccugguggagaauucacaguguccccuagaaaugcuccaggugaaauacuauggagcgcaccuuugggcccugauuugaaccccuaccuuucucauuugucuagaauguauaaugguuaugcaggugguuuugaagugcaagugauccucgcggggaacgcguucaccgccgggaaggucauauuugcagcagucccuccaaacuucccaacugaaggucugagcccuagccaaguuacuauguucccccacauaauuguagauguuagacaauuggaaccuguguugaucccccuacccgauguuaggaauaauuuuuaccauuacaaucaggcacaugauucuacccucaaguugauagcaaugcuguauacaccacuuagagcuaauaaugccggggaugauguguucacagucucuugucgaguucucacgaggccaucccccgauuuugauuuuauauuucuggugccacccacaguugaaucaagaacuaaaccauuuacugucccagucuugaccgucgaggaaaugacuaauucaagauuccccauuccuuuggaaaagcuuuacacgggcccuagcagugcuauuguuguucaaccacaaaauggcagaugcacgacugacggugugcuacugggcaccacccagcugucagcugucaauaucugcaccuucaggggggaugucacccauauugcgggcagccgcaacuacacaaugaauuuggcaucccaaaacuggaacaauuaugacccaacagaagaaaucccagccccccugggaacaccagacuuugugggaaagauucaaggccugcucacccagaccacaagagcggacgguucgacccgugcccacaaggccacagugagcacugggaguguccacuucaccccaaagcuggguaguguucaauucuccacugacacagauaaugacuuccagccuggccaaaauacaaaguucaccccaguuggcgucauccaagacggcgaccgccaccaaaacgaaccccagcaaugggugcucccugauuucucagguagaaccggucauaaugugcaccuggccccugcuguugcccccacuuucccgggugagcagcuucuuuucuuuagguccaccaugccaggacguaguggguaccccaacaugaaucuggauugccuacucccucaggaauggguguugcacuuuuaccaggaaucagccccagcacaauccgauguggcucuauuaagauuugugaacccggauacaaacaggguucuguuugagugcaagcuucauaaaucaggcuauaucacaguggcccacaccggccaucaugauuugauucucccccccaaugguuauuuuagauuugauucuugggucaaucaauucuauacacucgcccccaugggaaauggagcggggcgcaggcguuaa

SEQ ID NO: 8375 - RNA, 1614 nt, Artificial Sequence
  VP1__Norovirus_and/or_Norovirus-like__KX514363
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauugggucaacucaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggggugccaauuucacuccaaagcugggcaaaguucgauuugaaacugauacaggcgaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucaggucuacucugcccggauguggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8376 - RNA, 1614 nt, Artificial Sequence
  VP1__Norovirus_and/or_Norovirus-like__KX514357
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguccaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgauuucacuccaaagcugggcaaaguucaauuugaaacugaaacagaccaugaucuugcaauucgccaaaacacaaaauucaccccagucggugucauccaggaaagugauaaccaccgagaugaaccccaacaauggaggcucccaaauuauucaggugcaaauaccuuuaauguacaccuagccccugcuguagcccccaauuuccccggugaacagcuucuuuucuucagauccacuauacccggauguggcgggcaucccaacaugaauuuggauugucuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8377 - RNA, 1614 nt, Artificial Sequence
  VP1__Norovirus_and/or_Norovirus-like__KX514240
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaauuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucaauuucaaacugaaacagaagaugaucuuguaauucgccaaaacacaaaauucaccccagucggugucauccaggaaagugaucaccaccgagaugaaccccaacaaugggugcucccaaguuauucagguagagauaccccuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8378 - RNA, 1614 nt, Artificial Sequence
  VP1__Norovirus_and/or_Norovirus-like__AF414417
augaagauggcgucgaaugacgccaacccaucugauggguccgcagccaaccucguuccagaggucaauaaugagguuauggcucuggagcccguuguugaugccgcuauugcggcaccuguggcgggccaacaaaacguaauugaccccuggauuagaaacaauuuuguacaagccccugguggagaguucacaguguccccuagaaacgcuccaggugagauacuguggagcgcgcccuugggcccugauccgaaccccuaucuuucucauuuguccagaauguacaaugguuaugcaggugguuuugaagugcaaguaauccucgcggggaacgcguucaccgccgggaaagucauauuugcagcagucccaccaaacuuuccuacugaaggcuuaagccccagccagguuacuauguucccccacauaauuguagauguuagacaauuggaaccuauguugaucccccuaccugauguuaggaauaauuucuaucauuacaaccaagcaaaugauucuacccuuaaguugauagcaacguuguacacaccacucagagcuaauaaugccggggaugaugucuucacagucucuugucgaguccucacgaggccaucccccgauuuugauuuuauauuucuggugccacccacaguugaaucaagaacuaaaccauucacugucccagucuugacuguugaggaaaugucuaauucaagauuccccauuccuuuggaaaagcuuuacacgggcccuaguagugcuuuugucguccaaccacaaaauggcagauguacgacugauggcguacuucuaggcacuacccagcugucagcuguuaauaucuguaacuuuaggggggauguugcccauauugcggguagccaugauuacacaaugaauuuggcaucccaaaauuggagcaauuaugacccaacagaagagaucccagccccccuaggaacgccagacuuugugggaaagauccaaggcuugcucacccagaccacaagagcggacggcuugacccgugcccacaaagcuacagugagcacugggaguguccacuucacuccaaagcuggguaguguucaauucaccacugacacgaacaaugauuuccaagcuggccaaaacacaaaauucaccccaguuggcgucauccaagacggugaucaccaccagaaugaaccccaacaaugguuacucccaaauuacucagguagaacuggucacaaugugcaccuggccccugcugucgcccccacuuuccccggugagcagcuucuuuucuuuagauccaccaugccaggguguagcggguaccccaacaugaauuuggauugcuuacucccccaggaauggguguugcacuuuuaccaggaagcagccccagcacaauccgauguggcacugcugagauuugugaauccagauacagguaggguucuguuugagugcaagcuucauaaaucaggcuauaucacaguggcccacaccggcccguaugauuugguucuccccccuaaugguuauuucagauuugauucuugggucaaccaguucuacacacucgcccccaugggaaauggaacggggcgcaggcguuaa

SEQ ID NO: 8379 - RNA, 1614 nt, Artificial Sequence
  VP1__Norovirus_and/or_Norovirus-like__KX514303
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccuggaggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggggaaaugaccaauucaagauuccccguaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauugggucaacucgccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgaauucacuccaaagcugggcaaaguucgauuugaaacugauacagaagaugaucuuguaauucgccaaaacacaaaauucaccccagucggugucauccagucaagugaccaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8380 - RNA, 1614 nt, Artificial Sequence
  VP1__Norovirus_and/or_Norovirus-like__KX514273
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaagguuugagccccagucagguuaccauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuuacgggaaagauccaagguaugcucacucaaaccacaaagggagaagguucgacccggggccauagagcuacaguuuauguugggagugccgaauucacuccaaagcugggcaaaguucgauuugaaacugauacagaagaugaucuuguaauucgucaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8381 - RNA, 1614 nt, Artificial Sequence
  VP1__Norovirus_and/or_Norovirus-like__KX514323
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucacuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccugggaacucuaaaauuuacacaaugaauuuggccucuccaaauuggaacaauuaugacccaacagaagagaucccagccccccugggaacuccagauuuugugggaaagauccaugguaugcucacccaaaccacacaggaaaauggcucgacccgggcccauagagcaacaguuuauguugggggugccaauuucacuccaaagcugggcaaaguucaauuugaaacugauacaggcgaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucauccccccuaauggcuacuuuagguuugauuccuggguuaaucaauucuacacacuugcccccaugggaaauggaacggggcguaagcguuaa

SEQ ID NO: 8382 - RNA, 1614 nt, Artificial Sequence
  VP1__Norovirus_and/or_Norovirus-like__KX514364
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauugggucaacuaaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggggugccaauuucacuccaaagcugggcaaaguucaauuugaaacugauacaggcgaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccccaggagugggugcagcacuucuaccaagaggcagcuccagcacaaucugauguggcuccauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8383 - RNA, 1614 nt, Artificial Sequence
  VP1__Norovirus_and/or_Norovirus-like__KX514338
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguacacaccacuuagggccaauaaugcuggggaugaugucuucacagucuccugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaacuuuguuguucaaccacaaaauggcagaugcaugauugauggcgugcucuuaggcaccacccaacugucuccuguuaacauuugcaccuucagaggggacguuacucaaauugggucaacuaaacauuggacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggggugccaauuucacuccaaagcugggcaaaguucaauuugaaacugauacagucgaugaucuugaaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8384 - RNA, 1614 nt, Artificial Sequence
  VP1__Norovirus_and/or_Norovirus-like__KX514316
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuaaaauuuacacaaugaauuuggccucuccaaauuggaacaauuaugacccaacagaagagaucccagccccucugggaacuccagauuuugugggaaagauccaagguaugcucacucaaaccacaaagggagaagguucgacccggggccauagagcuacaguuuauguugggagugcuaacuaugcuccaaagcuagguagaguucaauuugaaacugacacaacugaugaucuugaugcucaccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaagcguuaa

SEQ ID NO: 8385 - RNA, 1614 nt, Artificial Sequence
  VP1__Norovirus_and/or_Norovirus-like__KX514356
augaagauggcgucgagugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguucaggccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacugcuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggauaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgauuucacuccaaagcugggcaaaguucaauuugaaacugaaacagaccaugaucuugcaauucgccaaaacacaaaauucaccccagucggugucauccaggaaagugaucaccaccgagaugaaccccaacaauggaggcucccaaauuauucaggugcaaauaccuuuaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucaucccccccaauggcuacuuuagguuugauuccuggguuaaucaauucuacacacuugcccccaugggaaauggaacggggcguaagcguuaa

SEQ ID NO: 8386 - RNA, 1614 nt, Artificial Sequence
  VP1__Norovirus_and/or_Norovirus-like__KX514349
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucgcggggaaugcguuuaccgcgggaaaaauuauauuugcagcaguccccccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguacacaccacuuagggcuaacaauccuggggaugaugucuucacagucuccugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccaaucugggaacacuaaaauuuacacaaugaauuuggccucuccaaauuggaacaauuaugacccaacagaagagauuccagccccucugggaacuccagauuuuguaggaaagauccaagguaugcucacucaaaccacaaagggagaagguucgacccggggccauagagcuacaguauauguugggggugccgaauucacuccaaagcugggcaaaguucgauuugaaacugauacagaagaugaucuuguaauucgccaaaacacaaaauucaccccagucggugucauccagacaagugaaaaccaccgagaugaaccccaacaauggaggcucccaaauuauucagguagagauacccccaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauugagauuugugaauccagacacgaguaggguccuguuugagugcaaacuucauaaaucagguuaugucacaguggcucacaccggucaacaugauuuggucauccccccuaauggcuacuuuagguuugauuccuggguuaaucaauucuacacacuugcccccaugggaaauggaacggggcguaagcguuaa

SEQ ID NO: 8387 - RNA, 1614 nt, Artificial Sequence
  VP1__Norovirus_and/or_Norovirus-like__KX514217
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagccccagucaggucaccauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucgagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacucaaaccacacagggaaguggcucgacccgggcccauagagcaacaguuuauguugggagugccgaauucacuccaaagcugggcaaaguucaauuucaaacugaaacagaccaugaucuuguaauucgccaaaacacaaaauucaccccagucggugucauccaggaaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggccaauaugauuugguccuccccucuaaugguuauuuuagguuugauuccugggucaaucaauucuacacacuugcccccaugggaaauggaacggggcguaggcguuaa

SEQ ID NO: 8388 - RNA, 1614 nt, Artificial Sequence
  VP1__Norovirus_and/or_Norovirus-like__KX514324
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguauacaccacuuagggcuaacaauccuggggaugaugucuucacagucuccugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacucugggaacucuaaaauuuacacaaugaauuuggccucuccaaauuggaacaauuaugacccaacagaagagauuccagccccucuggggacuccagauuuuguaggaaagauccaagguaugcucacucaaaccacaaagggagaagguucgacccggggccauagagcuacaguuuauguugggggugccaauuucacuccaaagcugggcaaaguucaauuugaaacugauacagucgaugaucuugaaauucgccaaaacacaaaauucaccccagucggugucauccagucaagugaucaccaccgagaugaaccccaacaauggaggcucccaaauuauucaggugcaaauaccuuuaauguacaucuagccccugcuguagcccccaauuuccccggugaacagcuucuuuucuucagguccacucugcccggauguggugggcaccccaacauggacuuggauugccugcucccccaggagugggugcagcacuucuaccaagaggcagcuccagcacaaucugauguggcucuauugagauuugugaauccagacacgaguaggguccuguuugagugcaaacuucauaaaucagguuaugucacaguggcucacaccggucaacaugauuuggucaucccucccaauggcuacuuuagguuugauuccuggguuaaucaauucuacacacuugcccccaugggaaauggaacggggcguaagcguuaa

SEQ ID NO: 8389 - RNA, 1614 nt, Artificial Sequence
  VP1__Norovirus_and/or_Norovirus-like__KX514306
augaagauggcgucgagugacgccaacccaucugauggguccacagccaaccucgucccagaggucaacaaugagguuauggcuuuggagcccguugucggugucgcuauugcggcgccuguagcgggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucauagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcaggugcacgauugauggcgagcucuuaggcaccacccaacugucuucuguuaacauuugcaccuucagaggggacguuacucaaauugggucaacucaacauuggacaaugaauuuggccucuccaaauuggaacaauuaugacccaacagaagaaacuccagccccccugggaacuccagauuuuguaggaaagauccaagguaugcucacucaaaccacacaggaaaauggcucgacccgggcccauagagcaacaguuuauguugggggugccaacuaugcuccaaagcugggcaaaguucaauuugaaacugauacaggcgaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccccaggagugggugcagcacuucuaccaagaggcagcuccagcacaaucugaugugacucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8390 - RNA, 1614 nt, Artificial Sequence
  VP1__Norovirus_and/or_Norovirus-like__AB186063
augaagauggcgucgaaugacgucaacccaucugauggguccgcagccaaccucgucccagaggucaacaaugagguuauggcucuggagcccguuguuggugccgccauugcggcaccuguagcgggccaacaaaacauaauugaccccuggauuagaaauaauuuuguacaagccccugguggagaauucacaguguccccuaggaaugcuccaggugaaauacuauggagcgcaccuuugggcccugauuugaaccccuaccuuucucauuugucuagaauguauaaugguuaugcaggugguuuugaagugcaagugauccucgcggggaacgcguucaccgcugggaaggucauauuugcggcagucccuccaaacuucccaacugaaggucugagcccuagucaagucacuauguucccccauauaauuguagauguuagacaauuagaaccuguguugaucccccuacccgauguuaggaauaacuuuuaccauuacaaucaggcacaugauucuacccucaaguugauagcaaugcuguacacaccacuuagagcuaauaaugccggggaugauguguucacagucucuugccgaguucuuacgaggccaucccccgauuuugauuuuauauuucuggugccacccacaguugaaucaagaacuaaaccauuuacugucccagucuugaccgucgaggaaaugacuaauucaagauuccccauuccuuuggaaaagcuuuacacgggcccuaguagugccuuuguuguucaaccacaaaauggcagaugcacgacugacgguguguuacugggcacuacccagcugucagcugucaauaucugcaccuucaggggggacgucacccauauugcgggcagccgcaacuacacaaugaauuuggcaucccaaaacuggaacaauuaugacccaacagaagaaaucccagccccccugggaacaccagacuuugugggaaagauccaaggcuugcucacccagaccacaagagcggacgguucgacccgugcccacaaggccacagugagcacugggaguguccacuucaccccaaagcuggguaguguucaauucuccacugacacagauaaugacuuccagccuggccaaaauacaaaguucaccccaguuggcgucauccaagacggcgaccgccaccaaaacgaaccccagcaaugggugcucccagauuacucagguagaacuggccacaaugugcaccuggccccugcuguugccccuacuuuccccggugagcagcuucuuuucuuuagguccaccaugccaggauguaguggguaccccaacaugaaucuggauugccuacucccucaggaauggguguugcacuuuuaucaggaaucagccccagcacaauccgauguggccuugcuaagauuugugaacccggacacaaacaggguccuguuugagugcaagcuucauaagucaggcuauauuacaguggcccacaccggccagcaugauuugauucucccccccaaugguuauuuuagauuugauucuugggucaaucaauucuacacacucgcccccaugggaaauggagcggggcgcaggcguuaa

SEQ ID NO: 8391 - RNA, 1614 nt, Artificial Sequence
  VP1__Norovirus_and/or_Norovirus-like__AF406793
augaagauggcgucgagugacgccaacccaucugauggguccacagccaaccucgucccagaggucaacaaugagguuauggcuuuggagcccguuguuggugccgcuauugcgggaccuguagcgggccaacagaauguaauugaccccuggauuagaaauaauuuuguacaagccccugguggagaguuuacaguguccccuacaaacgcuccgggugagauacuauggagcgcgcccuugggcccugauuugaaccccuaccuuucccauuuggccagaauguacaaugguuaugcagguggcuuugaagugcagguaauccucgcggggaacgcguucaccgccgggaaaaucauauuugcagcagucccaccaaauuuuccaacugaaggcuugagccccagccagguuacuauguucccccauauaauaguagauguuaggcaauuggaaccuguguugauccccuuaccugaugcuaggaauaauuuuuaucauuacaaucagucaaacgauucuaccauuaaauugauagcaaugcuguauacaccacucagggccaauaaugcuggggaugaugucuucacagucucuugucgaguccucacgaggccaucccccgauuuugauuucauauucuugguaccacccacagucgaaucaagaacuaaaccauucaccgucccaaucuuaacuguugaggaaauguccaauucaagauuccccauuccuuuggaaaaguuguacacgggucccagcaguguuuuuguuguccaaccacaaaauggcaggugcacgacugauggcgugcucuuaggcacuacccagcugucugcugucaacaucugcaccuucagaggggaugucacccacauugcaggcagucaugauuacacaaugaauuuggcuucucaaaauuggaacaauuaugacccaacagaagaaaucccagccccucugggaaccccagauuucgugggaaagauccaaggcaugcucacccaaaccacaagagaggauggcucgacccgcgccacaaaagccacagugagcacugggaguguccacuuuacuccaaagcugggcaguguucaguacaccgcugacacaaacaaugauuuucaaacuggccaaaacacgaaauucaccccagucggcgucauccaggacgguaguaaccaucaaaaugaaccccaacaaugggugcucacaaacuacucagguagaacuggucauaaugugcaccuagccccugccguugcccccacuuuuccgggugaacaacuucucuucuuuagguccacuaugcccggauguagcggguaucccaauaugaaucuggauugccuacucccccaggaaugggugcagcacuucuaccaagaagcagcuccagcacaaucugauguggcucuguugagauuugugaauccagacacagguaggguucuguuugagugcaagcuccauaaaucaggcuaugucacaguggcucacacuggcccgcaugauuugguuaucccccccaaugguuacuuuagauuugauccuugggucaaccaguucuacacacuugcccccaugggaaauggagcggggcgcagacguuaa

SEQ ID NO: 8392 - RNA, 1614 nt, Artificial Sequence
  VP1__Norovirus_and/or_Norovirus-like__KX514223
augaagauggcgucgagugacgccaacccaucugauggguccacagccaaccucgucccagaggucaacaaugagguuauggcuuuggagcccguugucggugccgcuauugcggcgccuguagcgggccaacaaaauguaauugaccccuggauuagaaauaauuuuguucaagccccugguggagaguucaccguaucuccuagaaacgcuccaggugaaauacuauggagcgcgcccuuagguccugaccugaaucccuaccuaucucauuuggccagaauguauaaugguuaugcaggugguuuugaagugcagguaauccucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaauuuggaaagauuauucacgggacccagcagugccaauguuguucaaccacaaaauggcaggugcacgauugauggcgagcucuuaggcaccacccaacugucuucuguuaacauuugcaccuucagaggggacguuacucacauugggucaacucaccauuggacaaugaauuuggccucuccaaauuggaacaauuaugacccaacagaagaaacuccagccccccugggaacuccagauuuugugggaaagauccaugguaugcucacccaaaccacacagggaaguggcucgacccgggcccauagagcaacaguuuauguugggagugccgauuucacuccaaagcugggcaaaguucaauuugaaacugaaacagaccaugaucuugcaauucgccaaaacacaaaauucaccccagucggugucauccaggaaagugaucaccaccgagaugaaccccaacaauggaggcucccaaauuauucaggugcaaauaccuuuaauguacaccuagccccugcuguagcccccaauuuccccgaugaacagcuucuuuucuucagguccacucugcccggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuccauaaaucagguuaugucacaguggcucacaccggucaacaugauuugguuaucccccccaauggcuacuuuagguuugauuccuggguuaaucaauucuacacacuugcccccaugggaaauggaacggggcguaagcguuaa

SEQ ID NO: 8393 - RNA, 1614 nt, Artificial Sequence
  VP1__Norovirus_and/or_Norovirus-like__KX514318
augaagauggcgucgaaugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucagguuaccauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuccccguaaauuuggaaagauuauucacgggacccagcagugccaauguuguucaaccacaaaauggcagaugcaugauugauggcgugcucuuaggcaccacccaacugucuccuguuaacauuugcaccuucagaggggaugucacccacccugggggcucuaaaauuuacacaaugaauuuggccucuccaaauuggaacaauuaugacccaacagaagagauuccagccccccugggaacuccagauuuugugggaaagauccaugguaugcucacccaaaccacacaggaaaauggcucgacccgggcccauagagcaacaguuuauguugggggugccaauuucacuccaaagcugggcaaaguucaauuugaaacugauacagaagaugaucuugcaauucgccaaaacacaaaauucaccccagucggugucauccagucaagugaucaccaccgagaugaaccccaacaauggaggcucccaaauuauucagguagagauacccccaauguacaccuagccccuacuguagcccccaauuuccccggugaacagcuucuuuucuucagguccacucugcccggauguggugggcaccccaacauggacuuggauugccugcucccccaggagugggugcagcacuucuaccaagaggcagcuccagcacaaucugaugugacucuauugagauuugugaauccagacacgaguaggguccuguuugagugcaaacuucauaaaucagguuaugucacaguggcucacaccggucaacaugauuuggucaucccucccaauggcuacuuuagguuugauuccuggguuaaucaauucuacacacuugcccccaugggaaauggaacggggcguaagcguuaa

SEQ ID NO: 8394 - RNA, 1614 nt, Artificial Sequence
  VP1__Norovirus_and/or_Norovirus-like__AB186065
augaagauggcgucgaaugacgucaacccaucugauggguccgcagccaaccucgucccagaggucaacaaugagguuauggcucuggagcccguuguuggugccgccauugcggcaccuguggcgggccaacaaaacauaauugaccccuggauuagaaauaauuuuguacaagccccugguggagaauucacaguguccccuaggaaugcuccaggugaaauacuauggagcgcaccuuugggcccugauuugaaccccuaccuuucucauuugucuagaauguauaaugguuaugcaggugguuuugaagugcaagugauccucgcggggaacgcguucaccgcugggaaggucauauuugcggcagucccuccaaacuucccaacugaaggucugagcccuagucaaguuacuauguucccccauauaauuguagauguuagacaauuagaaccuguguugaucccccuacccgauguuaggaauaacuuuuaccauuacaaucaggcacaugauucuacccucaaguugauagcaaugcuguacacaccacuuagagcuaauaaugccggggaugacguguucacagucucuugccgaguucucacgaggccaucccccgauuuugauuuuauauuucuggugccacccacaguugaaucaagaacuaaaucauuuacugucccagucuugaccgucgaggaaaugacuaauucaagauuccccauuccuuuggaaaagcuuuacacgggcccuaguagugccuuuguuguucaaccacaaaauggcagaugcacgacugacgguguguuacugggcacuacccagcugucagcugucaauaucugcaccuucaggggggacgucacccauauugcgggcagccgcaacuacacaaugaauuuggcaucccaaaacuggaacaauuaugacccaacagaagaaaucccagccccccugggaauaccagacuuugugggaaagauccaaggcuugcucacccagaccacaagagcggacgguucgacucgugcccacaaggccacagugagcacugggaguguccacuucaccccaaagcuggguaguguucaauucuccacugacacagacaaugacuuccagccuggccaaaauacaaaguucaccccaguuggcgucauccaagacggcgaccgccaccaaaacgaaccccagcaaugggugcucccagauuacucaggcagaacuggccacaacgugcaccuggccccugcuguugcccccacuuuccccggugagcagcuucuuuucuuuagguccaccaugccaggauguaguggguaucccaacaugaaucuggauugcuuacucccucaggaauggguguugcacuuuuaucaggaaucagccccagcacaauccgauguggccuugcuaagauuugugaauccggacacaaacaggguccuguuugagugcaagcuucauaaaucaggcuauauuacaguggcccacaccggccagcaugauuugauucucccccccaaugguuauuuuagauuugauucuugggucaaucaauucuacacacucgcccccaugggaaauggagcggggcgcaggcguuaa

SEQ ID NO: 8395 - RNA, 1614 nt, Artificial Sequence
  VP1__Norovirus_and/or_Norovirus-like__KX514307
augaagauggcgucgagugacgccaacccaucugauggguccacagccaaccucgucccagaggucaacaaugagguuauggcuuuggagcccguugucggugccgcuauugcggcgccuguagugggccaacaaaauguaauugaccccuggauuagaaauaauuuuguucaagccccugguggagaguuuaccguaucuccuagaaacgcuccaggugaaauacuauggagcgcgcccuuagguccugaccugaaucccuaccuaucucauuuggccagaauguauaaugguuaugcaggugguuuugaagugcagguaauucucgcggggaacgcguucaccgccggaaaaauuauauuugcagcagucccaccaacuuucccaacugaaggcuugagucccagucaggucaccauguucccccauauaauaguagauguuaggcaauuggaaccuguguugaucccuuuaccugauguuaggaauaacuucuaucauuacaaucagucaaaugauuccaccauuaaauugauagcaaugcuguacacaccacuuagggcuaacaauccuggggaugaugucuucacagucuccugucgaguccucacgaggccauccccugauuuugacuuuauauuucuggugccaccuacaguugagucaagaacuaaaccauuuucugucccaauccuaacuguuggagaaaugaccaauucaagauuucccauaaacuuggaaagauuauucacgggacccagcagugccaauguuguucaaccacaaaauggcagaugcaugauugauggcgugcucuuaggcaccacccaacugucuccuguuaacauuugcaccuucagaggggaugucacccacccugggggcucuaaaauuuacacaaugaauuuggccucuccaaauuggaacaauuaugacccaacagaagaaacuccagccccccugggaacuccagauuuugugggaaagauccaugguaugcucacccaaaccacacaggaaaauggcucgacccgggcccauagagcaacaguuuauguugggggugccaauuucacuccaaagcugggcaaaguucgauuugaaacugauacaggcgaugaucuugcaauucgccaaaacacaaaauucaccccagucggugucauccagucaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcccggauguggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucacaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8396 - RNA, 1614 nt, Artificial Sequence
  VP1__Norovirus_and/or_Norovirus-like__LC048948
augaagauggcgucgagugacgccaacccaucugauggguccgcagccaaccucgucccagaggucaacaaugagguuauggcuuuggagcccguuguuggugccgcuauugcggcaccuguagcgggccaacaaaauauaauugaccccuggauuagaaauaauuuuguacaagccccugguggagaguuuacaguguccccuagaaacgcuccaggugagauacuauggagcgcgccccugggcccugaucugaaucccuaucuuucucauuuguccagaauguauaaugguuaugcaggugguuuugaagugcaagugauccuugcggggaacgcguucaccgccgggaagguuauauuugcagcgguuccaccaaacuuuccaacugaaggcuuaagccccagccagguuacuauguucccccauauaauuguagauguuaggcaacuggaaccuguguugauuccccuaccugauguuaggaauaauuucuaucauuauaaucaaucacaugauucuacccuuaaguugauagcagugcuguacacaccacuuaggacuaauaaugccggggaugaugucuuuacagucucuugucgaguucucacgaggccaucccccgauuuugauuucauauucuuggugccacccacaguugaaucaagaacuaaaccauucacugucccaaucuuaaccguugaggaaauguccaauucaagauuccccauuccuuuggaaaaguuguauacgggucccagcagugcuuuuguuguccaaccacaaaauggcagaugcacgacugacggcgugcucuuaggcacuacccagcugucagcugucaacaucugcaauuuuaggggggaugucacccauauugugggcagccaugagacuacaaugaacuuggcuucccaaaauuggagcaauuaugacccaacacaaaaaaucccagccccccugggaacaccacauuuuguggggaagauccaaggucugcucacccaaaccacaagagcacauggcucgacccgugcccacaaagcuacagugagcacugggaguguccacuucacuccaaagcuggguaguguucaauucaccacugacacaaacaaugauuuccaaacuggccaaaacacgaaauucaccccaguuggugucauccaagacggugaccaccaccagaaugagccccaacaauggguacucccgaauuauucagguagaacuggucauaaugugcaccuggccccugcuguugcccccacuuuuccgggugagcaacuccuuuucuuuagauccacuaugcccggguguagcggguaucccaacaugaacuuggauugccuacucccucacgaaugggugcugcacuucuaccaggaagcagcuccagcgcaaucugauguggcucugcugagauuugugaaucccgacacagguaggguucuguuugagugcaagcuccauaaaucaggcuauaucacaguggcccacaccggcccguuugacuuggguauccccccuaaugguuauuuuagauuugauuccugggucaaucaguucuacacacuugcccccaugggaaaugggacggggcgcaggcguuaa

SEQ ID NO: 8397 - RNA, 1614 nt, Artificial Sequence
  VP1__Norovirus_and/or_Norovirus-like__LC048908
augaagauggcgucgagugacgccaacccaucugauggguccgcagccaaccucgucccagaggucaacaaugagguuauggcucuggagcccguuguuggugccgcuauugcggcaccuguagcgggccaacaaaauauaauugaccccuggauuagaaauaauuuuguacaagccccugguggagaguucacaguguccccuagaaacgcuccaggugagauacuauggagcgcgcccuugggcccugauuugaaccccuaucuuucucauuuguccagaauguauaaugguuaugcaggugguuuugaagugcaagugauccucgcggggaacgcguucaccgccgggaaaguuauauuugcagcaguuccaccaaacuuuccaacugaaggcuuaagccccagccagguuacuauguuuccccauauaauuguagauguuaggcaauuggaaccuguguugauuccccuaccugaugucaggaauaauuucuaucauuacaaucaaucacaugacucuacccuuaaguugauagcaaugcuguacacaccacuuagggcuaauaaugccggggaugaugucuuuacagucucuugucgaguucucacgaggccaucccccgauuuugauuucauauucuuggugccacccacaguugaaucaagaacuaaaccauucaccgucccaaucuuaaccguugaggaaauguccaauucaagauuccccauuccuuuggaaaaguuguauacgggucccagcagugcuuuuguuguccaaccacaaaauggcagaugcacgacugauggcgugcucuuaggcaccacccagcugucagcugucaacaucugcaacuuuaggggggaugucacccauauugugggcagccaugauuacacaaugaauuuggcuucccaaaauuggagcaauuaugacccaacagaagaaaucccagccccccugggaacaccagauuuuguggggaagauccaaggccugcucacccaaaccacaagagcacauggcucgacccgugcccacaaagcuacagugagcacugggaguguccacuucacuccaaagcuggguaguguucaauuuaccacugacacaaacaaugauuuccaaaccggccaaaacacgaaauucaccccaguuggcgucauccaagacggugaccaccaccagaaugagccccaacaauggguacuuccaaauuauucagguagaacuggucauaaugugcaccuggccccugccgucgcccccacuuuuccgggugagcaacuccuuuucuuuagauccacuaugcccggguguagcggguaucccaacaugaacuuggauugccuacucccccaggaaugggugcugcacuucuaccaggaaacagcucccgcacaacccgauguggcucugcugagauuugugaauccagacacaaguaggguucugugugaguguaagcucccuaaaucaggcuauaucacaguggcucacacgggcccguaugacuugguuauccccccuaauggcuauuuuagauuugauuccugggucaaccaguucuacacacuugcccccaugggaaaugggacggggcgcaggcguuaa

SEQ ID NO: 8398 - RNA, 1614 nt, Artificial Sequence
  VP1__Norovirus_and/or_Norovirus-like__KX514312
augaagauggcgucgagugacgccaacccaucugauggguccgcagccaaccucgucccagaggucaacaaugagguuauggcuuuggagcccguugucggcgccgcuauugcggcaccuguagcgggccaacaaaauguaauugaccccuggauuagaaauaauuuuguacaagccccugguggagaguucaccguauccccuagaaacgcuccaggugaaauacuauggagcgcgcccuuagguccugaccugaaucccuaccuaucucauuuggccagaauguauaaugguuaugcaggugguuuugaagugcaggugauccucgcggggaacgcguucaccgccggaaaaauuauauuugcagcagucccaccaacuuucccaacugaaggcuugagucccagucagguuaccauguucccccauauaauaguagauguuaggcaauuggaaccuguguugaucccuuuaccugauguuaggaauaacuucuaucauuacaaucagucaaaugauuccacuauuaaauugauagcaaugcuguacacaccacuuagggcuaacaauccuggggaugaugucuucacagucuccugucgaguccucacgaggccauccccugauuuugacuuuauauuucuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccugggggcucuaaaauuuacacaaugaauuuggccucuccaaauuggaacaauuaugacccaacagaagagauuccagccccucugggaacuccagauuuugugggaaagauccaugguaugcucacccaaaccacacaggaaaauggcucgacccgggcccauagagcaacaguuuauguugggggugccaauuucacuccaaagcugggcaaaguucaauuugaaacugauacaggcgaugaucuugcaauucgccaaaacacaaaauucaccccagucggugucauccagucaagugaucaccaccgagaugaaccccaacaauggaggcucccaaauuauucagguagagauacccccaauguacaucuagccccugcuguagcccccacuuucccgggugaacaacuucuuuucuucagauccacuauacccggauguggcgggcaucccaacaugaauuuggauugccuacucccccaggagugggugcagcacuucuaucaagaggcagcuccagcacaaucugauguggcucuauuaagauuugugaauccagacacgaguaggguccuguuugagugcaaacuucauaaaucagguuaugucacaguggcucacaccggucaacaugauuuggucaucccucccaauggcuacuuuagguuugauuccuggguuaaucaauucuacacacuugcccccaugggaaauggaacggggcguaagcguuaa

SEQ ID NO: 8399 - RNA, 1614 nt, Artificial Sequence
  VP1__Norovirus_and/or_Norovirus-like__KX514237
augaagauggcgucgaaugacgccaacccaucugauggguccgcagccaaccucgucccagaggucaacaaugagguuauggcuuuggagcccguugucggcgccgcuaucgcggcaccuguagcgggccaacaaaauguaauugaccccuggauuagaaauaauuuuguacaagccccugguggagaguucacaguauccccuagaaacgcuccaggugaaauacuauggagcgcgcccuuagguccugaucugaaucccuaccuaucucauuuggcuagaauguauaaugguuaugcagguggcuuugaagugcaggugauccucguggggaaugcguuuaccgcgggaaaaauuauauuugcagcagucccuccaaauuuuccaacugaaggcuugagucccagccaggucacuauguucccccauauaauaguagauguuaggcaauuagaaccuguguugauccccuuaccugauguuaggaauaacuucuaucauuauaaucagucaaaugauucuaccauuaaauugauagcaaugcuguauacaccacuuagggccaauaaugcuggggaugaugucuucacagucucuugucgaguccucacgaggccauccccugauuuugacuucauauuccuggugccaccuacaguugagucaaggucuaagcccuuuucugucccagucuuaacuguugaagaaaugaccaauucaagauuccccgcuacuuuggauaaauuguucacaggucccagcaguaccuuuguuguucaaccacaaaauggcagaugcaugauugauggcgugcucuuaggcaccacccaacugucuccuguuaacauuugcaccuucagaggggaugucacccacccuagggacucuccaauuuacacaaugaauuuggccucuccaaauuggaacaauuaugacccaacagaagagauuccagccccucugggaacuccagauuuugugggaaagauccaagguaugcucacccaaaccacacagggaaguggcucgacccgggcccauagagcaacaguuuauguugggagugccgauuucacuccaaagcugggcaaaguucaauuugaaacugaaacagaccaugaucuugcaauucgccaaaacacaaaauucaccccagucggugucauccaggaaagugaucaccaccgagaugaaccccaacaauggaggcucccaaauuauucaggugcaaauaccuuuaauguacaccuagccccugcuguagcccccaauuuccccggugaacagcuucuuuucuucagguccacucugcucggaugcggugggcaccccaacauggacuuggauugccugcucccccaggagugggugcagcacuucuaccaagaggcagcuccagcacaaucugauguggcucuauugagauuugugaauccagacacgaguaggguccuguuugaauguaaacuucauaaaucaggcuacgucacaguggcucacaccggucaauaugauuugguccuccccucuaaugguuauuuuagguuugauuccugggucaaucaauucuacacacuugcccccaugggaaauggaacggggcguaggcguuaa

SEQ ID NO: 8400 - RNA, 1614 nt, Artificial Sequence
  VP1__Norovirus_and/or_Norovirus-like__DQ419907
augaagauggcgucgaaugacgccagcccaucugauggguccacagccaaccucgucccagaggucaacaaugagguuauggcuuuggagcccguuguuggugccgcuauugcggcaccuguagcgggccaacagaauguaauugaccccuggauuaggaauaguucuguacaagccccugguggagaguucacaguauccccuagagacgcuccaggugaaauacuauggagcgcgcccuuaggcccugaucugaauccauaccuuucucaccuggccagaauguacaaugguuaugcaggugguuuugaagugcagguaauccucgcggggaacgcguucaccgccgggaaaaucauauuugcagcagccccaccaaauuucccaacugaaggcuugagccccagccaggucacuauguucccccacauaauaguagguguuaggcaauuggaaccuguguugauccccuuaccugauguuaggaauaauuucuaccauuacaaucaaucaaaugacuccaccauuaaauugauagcaaugcuguacacaccacucagagcuaauaaugcuggggaugaugucuucacagucucuugucgaguccucacgaggccaucccccgauuuugauuucauauuucuggugccacccacaguugagucaagaaccaaaccauucaccgucccaauuuuaacuguugaggaaaugaccaauucaagauuccccauuccuuuggaaaauuguucacgggucccagcagugccuuugucguccaaccacaaaaugcagugcacgacugauggcgugcucuuaggcacuacccagcugucccccgucaacaucugcaccuucagaggcgaugucacccacauuccagguacucguacuuacagaaugaauuuggcuucucaaaauuggaacaauuaugacccaacagaagaaaucccagccccucugggaacuccagauuucguaggaaagauccaaggcaugcucacccaaaccacaaagggagacggcucgacccgcggccacaaagcuacagugagcacugggaguguugacuuuacuccaaagcugggcagcguucaguucgccacugauacagacaaugauuuugaaacuggccaaaacacaagguucaccccagucggugucauccaggaugguaguaguacccacagaaaugaaccccaacaauggguacucccagauuacucagguagaacuguucauaauguacaccuggccccugccguagcccccacuuuuccgggugagcaacuucuuuucuucagaucuacuaugcccggaugcaguggguaccccaauauggauuuggauugucuacucccccaggaaugggugcagcacuucuaccaagaggcagccccaucacaaucugauguggcuuuguugagauuugugaauccagacacagguaggguucuguuugagugcaagcuucauaaagcaggcuaugucacaguggcucacacuggccagcaugauuugguuaucccccccaauggcuacuuuagauuugauuccugggucaaccaguucuacacacuugcccccaugggaaauggagcggggcguagacguuaa

SEQ ID NO: 8401 - RNA, 1614 nt, Artificial Sequence
  VP1__Norovirus_and/or_Norovirus-like__JN975543
augaggaugagugauggcgcagcgccaaaagccaacggcucugaagccagcggccaggaucuuguuccuaccgccguugaacaggccguccccauucagcccguggcuggcgcggcucuugccgcccccgccgccgggcaaaucaaccaaauugaccccuggaucuuccaaaauuuuguccaaugcccccuuggugaguuuuccauuucaccccgaaacaccccaggugaaauacuguuugaucuggcucucgggccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaauugccucuucuugaugugcgucgaguucuuuggcaugcuacccaggaucaggaggaaucuaugcgccugguuugcaugcuguacacgccacuccgcacaaacagcccgggugaugagucuuuuguggucucuggccgccuuuugucuaagccggcggcugauuuuaacuuuguauaccugacuccccccauugagagaaccauuuaccggauggucgauuugcccguguugcagccgcggcugugcacgcacgcacguuggcccgccccagucuauggccucuugguggacccaucccucccguccaacccccaguggcagaaugguagagugcauguugaugggacccuucuugguaccacaccuguguccggauccuggguuuccugcuuugcagcugaggcugccuacgaguuccaaucugggacuggugagguggcaaccuucacccugauugagcaggacggcaccgcuuaugucccuggcgacagagcggccccccuuggauaccccgauuucuccgggcaacuggagauugaggugcagacugagacuaccaaggcaggagauaaacuuaaagucaccaccuuugagaugauccuuggcccaacaacuaacguggaccaggcucccuaccagggcaggguguacgccagcaucacugcuauggccucccuugaucugguggauggcaggguccgcgcgguccccagauccaucuauagcuuucaggaugucaucccugaguacaaugaugggcuacugguuccccuugcccccccaauuggacccuuccucccuggcgagguccuccugagguuccgaaccuacaugcgucagcuugacaccgcugacgccgcagccgaggcaauagacugugcgcucccacaggaauucaucuccugguucgcgucuaacgcguucaccgugcagucugaagcccugcuccuuagguacaggaacacccugacgggacagcugcuguuugagugcaagcucuacagcgaggguuacaucgccuuguccuauucaggcucgggagcucucaccuucccgacugacggcuucuucgaggucgucagcugggucccccgccuuuaucaauuggccucugugggaagcuuggcaacaggccgauaa

SEQ ID NO: 8402 - RNA, 1614 nt, Artificial Sequence
  VP1__Norovirus_and/or_Norovirus-like__JN975541
augaggaugagugauggcgcagcgccaaaagccaacggcucugaagccagcggccaggaucuuguuccuaccgccguugaacaggccguccccauucagcccguggcuggcgcggcucuugccgcccccgccgcugggcaaaucaaccaaauugaccccuggaucuuccaaaauuuuguccaaugcccccuuggugaguuuuccauuucaccccgaaacaccccaggugaaauacuguuugaucuggcucucgggccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaauugccucuucuugaugugcgucgaguucuuuggcaugcuacccaggaucaggaggaaucuaugcgccugguuugcaugcuguacacgccacuccgcacaaacagcccgggugaugagucuuuuguggucucuggccgccuuuugucuaagccggcggcugauuuuaacuuuguauaccugacuccccccauugagagaaccauuuaccggauggucgauuugcccguguugcagccgcggcugugcacgcacgcacguuggcccgccccagucuauggccucuugguggacccaucccucccguccaacccccaguggcagaaugguagagugcauguugaugggacccuucuugguaccacaccuguguccggauccuggguuuccugcuuugcagcugaggcugccuacgaguuccaaucugggacuggugagguggcaaccuucacccugauugagcaggacggcaccgcuuaugucccuggcgacagagcggccccccuuggauaccccgacuucuccgggcaacuggagauugaggugcagacugagacuaccaagacaggagauaaacuuaaagucaccaccuuugagaugauccuuggcccaacaacuaacguggaccaggcucccuaccagggcaggguguacgcaagcaucacugcugcggccucccuugaucugguggauggcaggguccgcgcgguccccagauccaucuauagcuuucaggaugccaucccugaguacaaugaugggcuacugguuccccuugcccccccaauuggacccuuccucccuggcgagguccuccugagguuccgaaccuacaugcgucagcuugacaccgcugacgccgcagccgaggcaauagacugugcgcucccacaggaauucaucuccugguucgcgucuaacgcguucaccgugcagucugaagcccugcuccuuagguacaggaacacccugacgggacagcugcuguuugagugcaagcucuacagcgaggguuacaucgcccuguccuauucaggcucgggagcucucaccuucccgacugacggcuucuucgaggucgucagcugggucccccgccuuuaucaauuggccucugugggaagcuuggcaacaggccgauaa

SEQ ID NO: 8403 - RNA, 1614 nt, Artificial Sequence
  VP1__Norovirus_and/or_Norovirus-like__KF113526
augaggaugagugauggcgcagcgccaaaagccaacggcucugaagccagcggccaggaucuuguuccuaccgccguugaacaggccguccccauucagcccguggcuggugcgucucuugccgcccccgccgccgggcaaauuaaccaaauugaccccuggaucuuccaaaauuuuguccaaugcccccuuggugaguuuuccauuucaccucgaaacaccccaggugaaauauuguuugauuuggcccuugggccagggcucaaccccuaccuugcccaccucucagccauguacaccggcuggguugggaauauggagguucagcugguccucgccggcaaugccuuuacugcuggcaaggugguuguugcccuuguaccacccuacuuucccaaagggucacucaccgcugcccagaucacaugcuucccacauguuaugugugaugugcgcacuuuggaacccauucaacucccucuucuugacgugcgucgaguucuuuggcaugcuacccaggaucaggaggaaucuaugcgccugguuugcaugcuguauacaccacuccgcacgaacagcccgggugaugagucuuuuguggucucuggccgccuucuuucuaagccggcagcugauuucaauuuuguauaccugaccccccccauugagagaacuaucuaccggauggucgacuugcccguguuacagccgcggcugugcacgcaugcucguuggccagcaccgguuuauggucucuugguggaucccucccucccguccaauccucaauggcagaauggaagagugcauguugauggaacccuucuuggcacaacaccugucucuggguccugggucuccugcuuugcagcugaggccgccuacgaguuccaguccgggacuggugagguggcgacuuucacccugauugagcaggauggauccgcuuauguuccuggugacagagcggcccccuuggguuacccugauuucucuggacagcuagagauugaggugcagacugagaccaccaaggcaggugauaagcugaaagugaccacuuuugagaugauccuuggucccaccaccaacguggaccaggcgcccuaccagggcaggguguacgccagcuugacggcugcagccucccucgaccugguggauggcaggguuagggcugucccgcguuccauuuaugguuuccaggaucagaucccugaguauaaugauggucuucuuguuccccuugcccccccuguuggcccuuuccuccccggugaguugcucuugagguuccggaccuacaugcgccagaucgacagcgcugacgcugcagcggaggccauugacugcgcccucccacaggaguucaucucgugguucgcgagcaacgcguucacggugcagucggaggcucugcuccuuagguauaggaacacccugacugggcaguugcuguuugaguguaagcucuacagcgaaggcuacaucgcccuguccuauucgggcucaggaccgcucaccuuuccgacugauggcuucuuugagguugucagcugggucccccgucuuuaucaauuggccucugugggaagcuuggcaacaggccgauaa

SEQ ID NO: 8404 - RNA, 1614 nt, Artificial Sequence
  VP1__Norovirus_and/or_Norovirus-like__KF113527
augaggaugagugauggcgcagcgccaaaagccaacggcucugaagccagcggccaggaucuuguuccuaccgccguugaacaggccguccccauucagcccguggcuggugcgucucuugccgcccccgccgccgggcaaauuaaccaaauugaccccuggaucuuccaaaauuuuguccaaugcccccuuggugaguuuuccauuucaccucgaaacgccccaggugaaauauuguuugauuuggcccuugggccagggcucaaccccuaccuugcccaccucucagccauguacaccggcuggguugggaacauggagguucagcugguccucgccggcaacgccuuuacugcuagcaaggugguuguugcccuuguaccacccuacuuucccaaagggucacucaccacugcccagaucacaugcuucccacauguuaugugugaugugcgcacuuuggaacccauucaacucccucuucuugacgugcgucgaguucuuuggcaugcuacccaggaucaggaggaaucuaugcgccugguuugcaugcuguauacaccacuccgcacgaacagcccgggugaugagucuuuuguggucucuggccgccuucuuucuaagccggcagcugauuucaauuuuguauaccugaccccccccauugagagaacuaucuaccggauggucgacuugcccguguuacagccgcggcugugcacgcaugcucguuggccagcaccgguuuauggucucuugguggaucccucccucccguccaauccucaauggcagaauggaagagugcauguugauggaacccuucuuggcacaacaccugucucuggguccugggucuccugcuuugcagcugaggccgccuacgaguuccaguccgggacuggugagguggcgacuuucacccugauugagcaggauggauccgcuuauguuccuggugacagagcggcccccuuggguuacccugacuucucuggacagcuagagauugaggugcagacugagaccaccaaggcaggugauaagcugaaagugaccacuuuugagaugauccuuggucccaccaccaacguggaccaggcgcccuaccagggcaggguguacgccagcuugacggcugcagccucccucgaccugguggauggcaggguuagggcugucccgcguuccauuuaugguuuccaggaucagaucccugaguauaaugauggucuucuuguuccccuugcccccccuguuggcccuuuccuccccggugaguugcucuugagguuccggaccuacaugcgccagaucgacagcgcugacgcugcagcggaggccauugacugcgcccucccacaggaguucaucucgugguucgcgagcaacgcguucacggugcagucggaggcucugcuccuuagguauaggaacacccugacugggcaguugcuguuugaguguaagcucuacagcgaaggcuacaucgcccuguccuauucgggcucgggaccgcucaccuuuccgacugauggcuucuuugagguugucagcugggucccccgucuuuaucaauuggccucugugggaagcuuggcaacaggccgauaa

SEQ ID NO: 8405 - RNA, 1614 nt, Artificial Sequence
  VP1__Norovirus_and/or_Norovirus-like__KM458057
augaggaugagugauggcgcagcgccaaaagccgacggcucugaagccagcggccaggaucuuguuccuaccgccguugagcaggccguccccauucagcccguggcuggcgcggcucuugccgcccccgccgccgggcaaauuaaccaaauugaccccuggaucuuccaaaauuuuguccaaugcccccuuggugaguuuuccauuucaccucgaaacaccccaggugaaauauuguuugauuuggcccucggaccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucaaaucacaugcuucccacaugucaugugugaugugcgcacccuggagcccauucaauugccucuucuugacgugcgucgaguucuuuggcaugcuacccaggaucaggaggaaucuaugcgccugguuugcaugcuguacacgccacuccgcacaaacagcccgggugaugagucuuuuguggucucuggccgccuucuuucuaagccggcagcugauuucaacuuuguauaccugaccccccccauagagagaaccaucuaccggauggucgaccugcccgugauacagccgcggcugugcacgcacgcacguuggccugccccggucuauggccucuugguagacccaucccuucccucaaacccccaguggcagaauggaagagugcauguugauggaacccugcuuggcaccacuccggucucuggcucauggguguccugcuuugcggcagaggccgccuaugaguuccaaucaggcacgggucagguggcaacauucacccugaucgagcaagauggcucugccuauguucccggugacagggcagcgccacucgguuaccccgacuucuccgggcaacuggagaucgagguccaaaccgagaccaccaagacuggagacaagcucaagguuaccacuuuugagaugauccuuggcccaacaaccaacguggaucaggcccccuaccagggcaagguuuuugccagcaucaccgccgcggcaucccucgaucugguggacggcaggguucgcgcggucccaagguccauuuauggcuuccaggauguuaucccugaauacaaugaugggcuacugguuccucuugcccccccaauuggccccuuucuuccuggugagguucuccugagguuccggaccuauaugcgucagcuugacaccgcugaugccgcggcagaggcgauagacugugcacucccccaggaguuuaucucuugguucgcgucuaacguguucaccgugcagucugaagcccugcuucuuagguauaggaacacccugacugggcaauugcuguuugagugcaaacucuacagcgaggguuacaucgccuuguccuacucaggaucaggaccccucaccuucccgacugauggcuucuuugagguugucaguugggucccccgccuuuaucaauuggccucugugggaagcuuggcaacaggccgauaa

SEQ ID NO: 8406 - RNA, 1614 nt, Artificial Sequence
  VP1__Norovirus_and/or_Norovirus-like__AB662855
augaagauggcgucgaaugacgccgcuccaucuacugauggugcagccggccucgugccagaaaguaauaaugaggucauggcucuugaaccuguggcuggugccgcuuuggcagccccggucacuggucaaacaaauauuauagacccuuggauuagagcaaauuuuguccaggccccuaauggugaauuuacaguuucuccccguaaugccccuggugaagugcuguugagucuagaguuggguccagaauuaaauccuuaucuggcacacuuagcaagaauguacaauggacaugccggugggauggaggugcaagucauguuggcugggaacgcguucacagccggcaaguuggucuucgccgcugugccaccucauuucccgguugaaaaccuuaguccacagcaaauuaccauguucccucacgugauuauagauguaaggacuuuggaaccuguuuuauuaccacucccugaugugagaaauaauuucuuccauuauaaucagaaagaugaucccaaaaugagaauuguugcuaugcuuuauaccccccuuaggucuaaugguucaggugaugauguguuuacagucuccuguaggguguugacuagacccucuccugauuuugauuucacauaccuggugccaccaacaguggaauccaaaacaaaaccauuuacccuuccaauccucacacuuggggagcuuuccaauucuagauuuccaguguccauagaucagauguauacuagccccaaugaaguuauaucugugcagugucaaaaugguaggugcacacuggauggggagcuccaaggaacaacacaacuccaggucaguggcauuugugcuuucaagggagaaguuaccgcccauuugcaugacaaugaucaccuauauaaugucaccauuacaaacuugaauggguccccuuuugaccccucugaggacguccccgccccucugggugugccugacuuccagggaagggucuuuggugucaucucccaaagagauaaacagaaugccgcuggacauaaugaaccagcaaacaggggacacgacgcuguggucccuacuuacacagcacaguacacuccaaaacugggucaaguucaaauugguacguggcagaccgacgaucuccaagucaaucaaccaguuaaauuuaccccagucggccuuaaugacacugagcauuuuaaucaauggguggucccuagguaugcuggugcuuuaaaucuaaacacaaaucuugccccuucuguugcuccaguguuuccaggggagcgccugcucuuuuucagaucauauaucccccucaaaggugguuauggaaacccagccauugauugccuacuaccacaggagugggugcagcauuuuuaucaggaagcagccccuucaaugagugagguggcccuugucagguacaucaacccggacacuggucgggcacuguuugaggccaagcuccauagagcugguuucaugacggucucgagcaacaccagugcuccggugguugugccugccaacggauacuucagauuugacucuuggguaaaccaauucuauucucucgcccccaugggaacuggaaauggguaa

SEQ ID NO: 8407 - RNA, 1614 nt, Artificial Sequence
  VP1__Norovirus_and/or_Norovirus-like__AB809997
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcuuccccauuugauuguagauguuaggacauuggaaccuauuaugauacccuuaccugauguuaggaauguuuucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuagugccucccucuguagaguccaaaacuaaaccauucacacuuccaauauugaccauuucugaacuaaccaacucucgguuucccaucccaauugagcaacuguacacggcuccaaaugagaauaauguuguacagugucaaaauggaaggugcaccuuggauggagagcuucagggcaccacccagcugcuaucaagugcaguuugcucuuacaggggcaggacuguggcuaacaguggagacaauugggaccagaauuugcuccagcugaccuacccaaguggugcaagcuaugaccccacugaugaaguaccagcacccuugggcacccaggauuucagugggauauuguaugggguguuaacccaagacaaugaaagagaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggagucgcucagaaugaaaacacccccuuccagcaauggguucuaccacacuacgcaggugcucucgcucuaaacaccaauuuggcacccgcuguugccccgacuuucccuggcgagcaauuacuguucuucaggucccguguuccauguguucaaggccugcgggggcaggaugcuuucauagauugucuccuaccucaagagugggugaaucacuuuuaucaagaggcugcucccucccaagcagacguugcccucaucagguaugucaacccugauacuggucgcacgcuguuugaggccaaauugcacaggucagguuuuauuacuguaucacacacuggugccuacccucuugugguccccccaaauggucauuucagguuugauucuuggguuaaccaauucuacucacucgcccccaugggaacuggcaauggguaa

SEQ ID NO: 8408 - RNA, 1614 nt, Artificial Sequence
  VP1__Norovirus_and/or_Norovirus-like__AB810001
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaacuccccuggagagauucuauuaaauuuagaguuaggaccagauuugaauccuuauuuggcccaucuaucaagaauguacaauggauaugcuggagguguugaggugcaagugcuccuugcugggaaugcguucacagcaggaaagauauuauuugcagcaaucccacccaacuuuccuguagauaugauuagcccagcucaaaucacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuagugccucccucuguagaguccaaaacuaaaccauucacacuuccaauauugaccauuucugaacuaaccaacucccgguuucccaucccaauugagcaacuguacacggccccaaaugaaaauaauguuguacagugucaaaauggaaggugcaccuuggauggagagcuucagggcaccacccagcugcuaucaagugcaguuugcucuuacaggggcaggacuguggcuaacaguggggacaauugggaccagaauuugcuccagcugaccuacccaaguggugcaagcuaugaccccacugaugaaguaccagcacccuugggcacccaggauuucagugggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggagucgcucagaaugaaaacacccccuuccagcaauggguucuaccacacuacgcaggugcucucgcucuaaacaccaauuuggcacccgcuguugccccgacuuucccuggcgagcaauuacuguucuucaggucucguguuccauguguucaaggccugcgggggcaggaugcuuucauagauugucuccuaccucaagagugggugaaucacuuuuaucaagaggcugcucccucccaggcagacguugcccucaucagguaugucaacccugauacuggucgcacgcuguuugaggccaaauugcacaggucagguuuuauuacuguaucacacacuggugccuacccucuugugguccccccaaauggucauuucagguuugauucuuggguuaaccaauucuacucacucgcccccaugggaacuggcaauggguaa

SEQ ID NO: 8409 - RNA, 1614 nt, Artificial Sequence
  VP1__Norovirus_and/or_Norovirus-like__AB809992
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaacuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuagugccucccucuguagaguccaaaacuaaaccauucacacuuccaauauugaccauuucugaacuaaccaacucccgguuucccaucccaauugagcaacuguacacggccccaaaugagaauaauguuguacagugucaaaauggaaggugcaccuuggauggagagcuucagggcaccacccagcugcuaucaagugcagucugcucuuacaggggcaggacuguggcuaacaguggggacaauugggaccagaauuugcuccagcugaccuacccaaguggugcaagcuaugaccccacugaugaaguaccagcacccuugggcacccaggauuucagugggauauuguacgggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggagucgcucaaaaugaaaacacccccuuccagcaauggguucuaccacacuacgcaggugcucucgcucuaaacaccaauuuggcacccgcuguugccccgacuuucccuggcgagcaauuacuguucuucaggucccguguuccauguguucaaggccugcgggggcaggaugcuuucauagauugucuccuaccucaagaguggguggaucacuuuuaucaagaggcugcucccucccaagcagacguugcccucaucagguaugucaacccugauacuggucgcacgcuguuugaggccaaauugcacaggucagguuuuauuacuguaucacacacuggugccuacccucuugugguccccccaaauggucauuucagguuugauucuuggguuaaccaauucuacucacucgcccccaugggaacuggcaauggguaa

SEQ ID NO: 8410 - RNA, 1611 nt, Artificial Sequence
  VP1__Norovirus_and/or_Norovirus-like__AY130761
augaagauggcgucgaaugacgcuacuccaucugaugauggugcagccggccucguaccagagaucaacaaugagguuauggcucuugaacccgucgcuggggccuccauugcagccccuguagucgggcaacagaauauaauugaucccuggauuagaaauaacuuuguacaagccccugcuggugaauucacaguuuccccuagaaacucuccuggagaacuccuacuugauuuagaauugggcccugaacugaaucccuaucuugcacaccuggccaggauguacaaugggcaugcaggaggaauggaagugcagauaguacuggcugggaaugcguucacagcugguaagauccuauuugcugccaucccaccuagcuuccccuaugaaaauuugucacccgcucaauugacuauguguccccaugugauaguggaugugagacaacuagaaccagugcuucugccaaugccagauauaagaaauguuuucuaucacuauaaccagaacaacagucccaaacuuaggcuuguagcuaugcuuuacacuccuuugagagcuaacaacucaggugaugacguguucacgguguccugccggguuuuaacacgucccucuccagacuuccaguucaccuuucuggucccaccuacaguugaauccaaaacuaagaauuucacccuuccuguccucagagucucagagaugacaaauucaagauuccccguuguuuuggaccaaauguauacaagcaggaaugagaauaucauuguccaaccccaaaacggcagaugcacgacugacggugagcugcuuggcaccaccaccuugcagucugugucuauuugcaauuuuagaggaacaaugcaggcaaagcugaaugaacaaccacgauaccaauuacaacucaccaacuuggauggcucacccauagacccaacagaugacaugccugccccucuuggcacaccagacuuccaggccauguuguauggcguugcaagucaacgcuccuccagagacaacgccacuagggcacaugacgcacagauugacacugcgggugacacuuucgccccgaaaauuggccagguccguuucaaaucaagcucugaugauuuugaccuacaugacccuacaaaauucacacccauuggugucaauguggaugaccagcacccuuuuagacaguggucccugccaaacuaugguggucaccuugcccugaauaaucauuuagcccccgcugugacaccacucuucccuggcgagcagauuuuguuuuucagaucacacauuccaagcgccggaggccauacagacggugcuauagacugcuugcuaccccaagaauggauagagcacuucuaccaggaggcagcuccuucccagucugacaucgcacugguaagguucaucaacccugacacaggaagagugcuccuugaggcuaaguugcauaaacaaggcuuccuuacaguugcagcaucuggagaucaccccauugugaugcccacuaaugguuauuuuagguuugaagcuugggucaaccccuucuacacucucgcccccgugggaacugggucugggcgcaggaggauucaauaa

SEQ ID NO: 8411 - RNA, 1611 nt, Artificial Sequence
  VP1__Norovirus_and/or_Norovirus-like__KF806495
augaagauggcgucgaaugacgccaacccaucugauggguccgcagccaaccucgucccagaggucaacaaugagguuauggcuuuggagcccguuguuggugccgcuauugcggcgccuguggcgggccaacaaaauguaauugaccccuggauuagaaauaauuuuguacaagccccugguggagaguucacaauauccccuagaaaugcuccgggugaaauacuauggagugcacccuugggcccugauuuaaaccccuaccuuucucauuuggcuagaauguacaaugguuaugcagguggauuugaaguacaaguaguccucgcggggaaugcguucaccgccgggaaaaucauauuugcagcagucccaccaaauuuuccaacugaaggcuugagccccagccagguuacuauguucccccauauaauaguagauguuaggcaauuggaaccuguguugauucccuuacccgauguuaggaauaauuucuaucacuauaaccaaucaaaugauucuaccaucaaauugauagcaauguuguacacaccacuuagggcuaauaaugcuggggaugacgucuucacagucucuugucgaguccucacgaggccaucccccgauuuugauuucauauucuuagugccacccacaguugagucaagaaccaaaccauucaccgucccaguccuaacuguugaggaaaugaccaacucaagauuccccauuccucuggaaaagcuguucacgggacccagcagugcuuuuguuguccaaccacaaaauggcaggugcacgacugauggugugcucuugggcaccacccagcugucugcugucaacaucugcaccuucagaggggacgucacccacgucucagacaaaaccuuugcaaugaauuuggcuucuccaaauuggaacaauuaugacccaacagaagauaucccagccccccugggaacuccagauuucgugggaaggauccauggcaugcucacucaaaccacaaggagagauggcgcgacccgcggccacaaagccacagugagcacugggggugccgacuucacuccaaagcuggguaguguccgauacaucacugacacaaccgaugaucuugaaguccgugagaacacaaaauucaccccaaucggcguccuccacucuaguggugaacaccgagcugaacccgaucaauggagacucccagaauauucaggaagaaauguccacaaugugcaccuggcuccugccguugcccccaccuucccgggugagcaacuccucuucuucagauccgcucugcccggguguggcggguaccccaacacggaccuggacugccuacucccccaggagugggugcagcacuucuaccaggaagcagcgccagcacaaucugauguggcucugcugagguuugugaauccagacacagguaggguuuuguuugaaugcaagcuccauaaaucuggcuaugucacaguggcccacacuggcccgcaugauuugguuaucccccccaaugguuacuuuagauuugauuccugggucaaccaguucuacacacuugcccccaugggaaauggaacggggcguagacguuaa

SEQ ID NO: 8412 - RNA, 1611 nt, Artificial Sequence
  VP1__Norovirus_and/or_Norovirus-like__KF806503
augaagauggcgucgaaugacgccaacccaucugauggguccgcagccaaccucgucccagaggucaacaaugagguuauggcuuuggagcccguuguuggugccgcuauugcggcgccuguggcgggccaacaaaauguaauugaccccuggauuagaaauaauuuuguacaagccccugguggagaguucacaauauccccuagaaaugcuccaggugaaauacuauggagugcacccuuggguccugauuuaaaccccuaccuuucucauuuggcuagaauguacaaugguuaugcagguggauuugaaguacaaguaguccucgcggggaaugcguucaccgccgggaaaaucauauuugcagcagucccaccaaauuuuccaacugaaggcuugagccccagccagguuacuauguucccccauauaauaguagauguuaggcaauuggaaccuguguugauucccuuacccgauguuaggaauaauuucuaucacuauaaccaaucaaaugauucuaucaucaaauugauagcaauguuguacacaccacuuagggcuaauaaugcuggggaugacgucuucacagucucuugucgaguccucacgaggccaucccccgauuuugauuucauauucuuagugccacccacaguugagucaagaaccaaaccauucaccgucccaguccuaacuguugaugaaaugaccaacucaagauuccccauuccucuggaaaagcuguucacgggacccagcagugcuuuuguuguccaaccacaaaauggcaggugcacgacugauggugugcucuugggcaccacccagcugucugcugucaacaucugcaccuucagaggggacgucacccacguuucagacaaaaccuuugcaaugaauuuggcuucuccaaauuggaacaauuaugacccaacagaagaaaucccagccccccugggaacuccagauuucgugggaaggauccauggcaugcucacucaaaccacaaggagagauggcgcgacccgcggccacaaagccacagugagcacugggggugccgacuucacuccaaagcuggguaguguccgauacaucacugacacaaccgaugaucuugaaguccgugagaacacaaaauucaccccaaucgguguccuccacuccaguggugaacaccgagcugaacccgaucaauggagacucccagaauauucaggaagaaauguccacaaugugcaccuggcuccugccguugcccccaccuucccgggugagcaacuccucuucuucagauccgcucugcccggguguggcggguaccccaacacggaccuggacugccuacucccccaggaaugggugcagcacuucuaccaggaagcagcgccagcacaaucugacguggcucugcugagguuuguaaauccagacacagguaggguuuuauuugaaugcaagcuccauaaaucugguuaugucacaguggcccacacuggcccgcaugauuugguuaucccccccaaugguuacuuuagauuugauuccugggucaaccaguucuacacacuugcccccaugggaaauggaacggggcguagacguuaa

SEQ ID NO: 8413 - RNA, 1611 nt, Artificial Sequence
  VP1__Norovirus_and/or_Norovirus-like__KF712506
augaagauggcgucgagugacgccaacccaucugauggguccacagccaaccucgucccagaggccaacaaugagguuauggcuuuggagcccguuguuggugccgccauugcggcgccuguagcgggccaacaaaauguaauugaccccuggauuagaaacaauuuugugcaagccccugguggagaguuuacaguauccccuagaaacgcuccaggugaaguacuauggagcgcgcccuuaggcccugauuugaaucccuaccuuucccauuuggccagaauguacaaugguuaugcaggugguuuugaagugcagguaauccucgcggggaacgcguucgccgccggaaaaaucauauucgcagcagucccaccaaauuucucaacugaaggcuugagccccagccaggucacuauguucccccacuuaauaguagauguuaggcaacuggaaccugugaugauccccuuacccgauauuaggaauaauuucuaucauuacaaucaaucaaaugaucccaccaucaaauugauagcaauguuguauacaccucuuagggcuaauaauguuggugacgaugucuucacaguuucuugucggguacucacgagaccaucccccgauuuugauuucauauuucuagugccacccacaguugaaucaaaaaccaacccauucucuguuccaauucuaacuauugaggagaugaccaauucaagauuccccauuccuuuggaaaagcuguucacgggccccagcagugcccuuguuguucaaccacaaaacggcaggugcacgacugauggcgugcuccuggguaccacccaacugucuccugucaacaucugcaccuucagaggggaugucacccauacuacaaaaacucauaccuaccaaaugaauuuggcugcucaaaauuggaacaguuaugacccaacagaagaaaucccagccccccuaggaacuccagauuucgugggaaagauccaaggugugcucacccaaaccacgaaggaaaauggcucaacccgugcccacaaagcuacaguguacacugggaccgucgaguucacuccaaaacuggguagaauccaacuuuucacugacacagacaacgaucuugaagcuaaccaaaacacaaaguucaccccagucggugucauccaggauggugaccaccaaaaugaaccccaacaauggguacucccaaguuacucagguagaaauaaucacaaugugcaccuggcccccgcuguagcccccacuuuuccgggcgagcaacuucucuucuucagauccacuaugcccggaugcagcggguaccccaacaugaauuuggacugucugcuuccccaggaaugggugcaauauuucuaucaagaggcagccccagcacaaucugauguggcuuugcuaagauuugugaauccagauacagguaggguuuuguuugagugcaagcuucauaaaucagguuaugucacaguggcucacaccggccaccaugauuugguuauccccccuaaugguuauuucagauuugauuccugggucagccccuucuacacacuugcccccaugggaaauggaacggggcguagacguuaa

SEQ ID NO: 8414 - RNA, 1611 nt, Artificial Sequence
  VP1__Norovirus_and/or_Norovirus-like__KF712507
augaagauggcgucgagugacgccaacccaucugauggguccacagccaaccucgucccagaggccaacaaugagguuauggcuuuggagcccguuguuggugccgccauugcggcgccuguagcgggccaacaaaauguaauugaccccuggauuagaaacaauuuugugcaagccccugguggagaguuuacaguauccccuagaaacgcuccaggugaaguacuauggagcgcgcccuuaggcccugauuugaaucccuaccuuucccauuuggccagaauguacaaugguuaugcaggugguuuugaagugcagguaauccucgcggggaacgcguucgccgccggaaaaaucauauucgcagcagucccaccaaauuucucaacugaaggcuugagccccagccaggucacuauguucccccacuuaauaguagauguuaggcaacuggaaccugugaugauccccuuacccgauauuaggaauaauuucuaucauuacaaucaaucaaaugaucccaccaucaaauugauagcaauguuguauacaccucuuagggcuaauaauguuggugacgaugucuucacaguuucuugucggguacucacgagaccaucccccgauuuugauuucauauuucuagugccacccacaguugaaucaaaaaccaacccauucucuguuccaauucuaacuauugaggagaugaccaauucaagauuccccauuccuuuggaaaagcuguucacgggccccagcagugcccuuguuguucaaccacaaaacggcaggugcacgacugauggcgugcuccuggguaccacccaacugucuccugucaacaucugcaccuucagaggggaugucacccauacuacaaaaacucauaccuaccaaaugaauuuggcugcucaaaauuggaacaguuaugacccaacagaagaaaucccagccccccuaggaacuccagauuucgugggaaagauccaaggugugcucacccaaaccacgaagggaaauggcucaacccgugcccacaaagcuacaguguacacugggaccgucgaguucacuccaaaacuggguagaauccaacuuuucacugacacagacaacgaucuugaagcuaaccaaaacacaaaguucaccccagucggugucauccaggauggugaccaccaaaaugaaccccaacaauggguacucccaaguuacucagguagaaauaaucacaaugugcaccuggcccccgcuguagcccccacuuuuccgggcgagcaacuucucuucuucagauccacuaugcccggaugcagcggguaccccaacaugaauuuggacugucugcuuccccaggaaugggugcaauauuucuaucaagaggcagccccagcacaaucugauguggcuuugcuaagauuugugaauccagauacagguaggguuuuguuugagugcaagcuucauaaaucagguuaugucacaguggcucacaccggccaccaugauuugguuauccccccuaaugguuauuucagauuugauuccugggucagccccuucuacacacuugcccccaugggaaauggaacggggcguagacguuaa

SEQ ID NO: 8415 - RNA, 1611 nt, Artificial Sequence
  VP1__Norovirus_and/or_Norovirus-like__JX401281
augaagauggcgucgaaugacgccaacccaucugauggguccgcagccaaccucgucccagaggucaacaaugagguuauggcuuuggagccuguuguuggagcugcuauugcagccccaguggcaggucaacaaaauguaauugaccccuggauuagaaacaauuuugugcaagcccccgguggggaguuuacagugucuccuagaaaugccccaggugaaauauuauggaguaugccuuuaagcccugaauugaaccccuaccuuucacauuuaucuaggauguauaauggguaugcaggugguuuugaggugcaggugauccucgcggggaaugcguucaccgcggggaagaucauauucgcagcaauccccccaaauuuucccacugauggccugaguccuagucaggucaccauguuuccgcauauaauuguggauguuagacaauuggaaccugugcugauacccuuacccgauguuaggaacaauuuuuaucauuauaaucaggcaaaugauuccaccuugaaauugauagcuaugcuguacacaccacuuagagcuaauaaugcuggagaugauguuuuuacuguuucuugccguguauuaacaaggccauccccugauuuugauuucauauucuuggucccucccacagucgaaucaagaacgaaaccuuucacugucccuauacugacuguugaugaaaugaccaauucgagguucccuaccccccuggagaaauugcauacgggcccaaacaacucuauaguuguccaaccucagaauggaaggugcacaauugauggcguccucuugggcacuacgcaguuguccaccgucaacaucugcaacuuuagagguagcaccacacgugcaggucagucacacgccuacacgaugaauuuggucucucaaaauuggaacaauuaugacccaacagaggagauuccagccccuuuggggacaccagacuuugucgggaagaucgugggcaugcucucgcagaccaccagagagaacaguucaacgcgagcccacaaggccacggugagcacuggagaugcccacuucacgccaaagucaggcagugucuuguucaccacugacacugacgaccuccaaaauggccaaaauacaagauucaccccagucggaguugcacaagauggugaaccccaccagaaugagccacaacaauggcgacucccaaauuauucuggcacacccggccacaaugugcaccuggcacccccugucgcacccacuuucccaggugaacaguugcucuucuuuagguccaccaugccagguuguggugguuauccuaacauggauuuggauugccugcucccucaagagugggugcgccauuucuaccaagaagccgcaccagcacaaucugauguggcucugcugagguuugugaauccagacacgggaaggguguuauuugagugcaagcuccacaaggcaggauacaucacagucucucacacuggucccuaugacuuggucauuccaccuaaugguuacuuuagauuugauuccuggguuaaucaguuuuaugcacuugcccccaugggaacuggaacggggcgcagacguuaa

SEQ ID NO: 8416 - RNA, 1611 nt, Artificial Sequence
  VP1__Norovirus_and/or_Norovirus-like__KF806526
augaagauggcgucgaaugacgccagcccaucugauggguccgcagccaaccucgucccagaggucaacaaugagguuauggcuuuggagcccguuguuggugccgcaauugcggcgccuguagcgggccaacaaaauguaauugaccccuggauuagaaauaaauuuguacaagccccugguggagaguucacaguguccccuagaaacgcuccaggugaaauacuauggagcgcacccuuagguccugaucugaaucccuaccuuucccauuuggccaggauguacaaugguuaugcagguggcuuugaagugcagguaauccucgcggggaacgcguucaccgccgggaaaaucauauuugcagcagucccaccaaauuucccaacugaaggcuuaagucccagccaggucacuauguucccccauauaguaguagauguuagacaacuggaaccuguguugauccccuuacccgaugucaggaauaauuucuaccacuacaaccaaucaaaagaccccaccaucaaauugauagcaaugcuguacacaccacuuagggcuaauaaugcuggggaagaugucuucacagucucuugccgaguccucacgaggccaucccccgauuuugauuucauauucuuggugccacccacaguugagucaagaucaaaaccauucaccgucccaauuuuaacuguugaggaaaugaccaauucaagguuccccauuccuuuggaaaagcuguucacgggucccagcggugccuuuguuguccaaccacaaaauggcaggugcacgacugauggcgugcucuuaggcaccacccaacugucuccugucaacaucugcaccuucagaggggaucucacccacuuugcaggcacccacgaauacgcaaugaauuuggcuucucaaaauuggaauaauuaugacccaacagaagaaaucccagccccucugggagccccagauuucgugggaaagauccgaggugugcucacucaaaccacaaggagggacgguucgacccgcggccacagggcuacauugagcacugggagcgcccacuucacuccaaagcugggcagcauucgguuuuccacugauacaaacaaugauuuugaagcuggccaaaacacgaaauucaccccagucggugucuuccaggauggcgacaaccaccaaaaugaaccccaacaaugggugcucccaaauuauucaggugcaacugcccacaauguacaccuugccccugccguggcccccgcuuuuccgggugagcaacugcuuuucuucagguccaccaugcccggaugcagcggguaucccaacaugaauuuggauugucuacucccacaggaaugggugcagcacuucuaucaagaggcagccccagcacaaucugauguggcucugcuaagauuugugaacccagauacaaguaggguuuuguuugagugcaagcuccauaaaucagguuaugucacaguggcccauacuggccagcaugauuugguuauccccccuaauggcuacuuuagauuugauuccugggucaaccaauucuacacacuugcccccaugggaaauggaacggggcguagauaa

SEQ ID NO: 8417 - RNA, 1611 nt, Artificial Sequence
  VP1__Norovirus_and/or_Norovirus-like__KF806500
augaagauggcgucgaaugacgccaacccaucugauggguccgcagccaaccucgucccagaggucaacaaugagguuauggcucuggagcccguuguuggcgccgcuauugcggcgccuguggcgggccaacaaaauguaauugaccccuggauuagaaauaauuuuguacaagccccugguggagaguuuacaauauccccuagaaacgcuccaggugagauacuauggagcgcgcccuugggcccugauuuaaaccccuaccuuucucauuuggcuagaauguauaaugguuaugcagguggauuugaaguacaaguaguccucgcggggaacgcguucaccgccgggaaagucauauuugcagcagucccaccaaauuuuccaacugagggcuugagccccagccagguuacuauguuuccccauauaauaguagauguuaggcaauuggaaccuguguugauucccuuacccgauguuaggaauaauuucuaucacuauaaccaaucaaaugauucuaccaucaaauugauagcaaugcuguacacaccacuuagggcuaauaaugcuggggaugaugucuucacagucucuugccgaguccucacgaggccaucccccgauuuugauuucauauucuuggugcccccuacaguugaaucaaggaccaaaccauucucugucccaguccuaacuguugaggaaaugaccaacucaagauuccccaucccccuggaaaaacuguucacaggacccagcagugcuuuuguuguccaaccacaaaauggcaggugcacgacugauggcgugcucuuaggcacuacccagcugucugcugucaacaucugcaccuucagaggggacgucacccacguugcaggugacaccuuugcaaugaauuuggcuucucuaaauuggaacaauuaugacccaacagaagaaaccccagccccucugggaacuccagauuucgugggaaggauccauggcaugcucacucaaaccacaagaagugauggcgcgacccgcgcccacaaagccacagugagcacugggggugccgacuucacuccaaagcuggguaguguccgauacagcacugacacauccagugaccuugaaguccgcgaaaacacaaaauucaccccaaucggcguccuccauuccagugguggacaucgagcugaacccgaccaauggagacucccagaauauucaggaagaaauguucacaaugugcaucuggccccugccguugcccccaccuucccgggugagcaacuccucuucuucagauccacuaugcccggguguggcggguaccccaacauggaccuggacugccuacucccccaggagugggugcagcacuucuaccaggaagcagcgccagcacaauccgauguggcucugcugagguuugugaauccagacacagguaggguuuuguuugaaugcaagcuccauaaaucuggcuaugucacaguggcccacacuggcccgcaugauuugguuaucccccccaaugguuacuuuagauuugauuccugggucaaccaguucuacacacuugcccccaugggaaauggaacggggcguagacguuaa

SEQ ID NO: 8418 - RNA, 1611 nt, Artificial Sequence
  VP1__Norovirus_and/or_Norovirus-like__KF806498
augaagauggcgucgaaugacgccaacccaucugauggguccgcagccaaccucgucccagaggucaacaaugagguuauggcuuuggagcccguuguuggugccgcuauugcggcgccuguggcgggccaacaaaauguaauugaccccuggauuagaaauaauuuuguacaagccccugguggagaguucacaauauccccuagaaaugcuccaggugaaauacuauggagugcacccuugggcccugauuuaaaccccuaccuuucucauuuggcuagaauguacaaugguuaugcagguggauuugaaguacaaguaguccucgcggggaaugcguucaccgccgggaaaaucauauuugcagcagucccaccaaauuuuccaacugaaggcuugagccccagccaggucacuauguucccccauauaauaguagauguuaggcaauuggaaccuguguugauucccuuacccgauguuaggaauaauuucuaucacuauaaccaaucaaaagauucuaccaucaaauugauagcaaugcuguacacaccacuuagggcuaauaaugcuggggaugacgucuucacagucucuugucgaguccucacgaggccaucccccgauuuugauuucauauucuuggugcccccuacaguugaaucaaggaccaaaccauucucugucccaguccuaacuguugaggaaaugaccaacucaagauuccccaucccccuggaaaaacuguucacaggacccagcagugcuuuuguuguccaaccacaaaauggcaggugcacgacugauggcgugcucuuaggcacuacccagcugucugcugucaacaucugcaccuucagaggggacgucacccacguugcaggugacaccuuugcaaugaauuuggcuucucuaaauuggaacaauuaugacccaacagaagaaaccccagccccucugggaacuccagauuucgugggaaggauccauggcaugcucacucaaaccacaagaagugauggcgcgacccgcgcccacaaagccacagugagcacugggggugccgacuucacuccaaagcuggguaguguccgauacagcacugacacauccagugaucuugaaguccgcgaaaacacaaaauucaccccaaucggcguccuccauuccagugguggacaucgagcugaacccgaccaauggagacucccagaauauucaggaagaaauguucacaaugugcaucuggccccugccguugcccccaccuucccgggugagcaacuccucuucuucagauccacuaugcccggguguggcggguaccccaacauggaccuggacugccuacucccccaggagugggugcagcacuucuaccaggaagcagcgccagcacaaucugauguggcucugcugagguuugugaauccagacacagguaggguuuuguuugaaugcaagcuccauaaaucuggcuaugucacaguggcccacacuggcccgcaugauuugguuaucccccccaaugguuacuuuagauuugauuccugggucaaccaguucuacacacuugcccccaugggaaauggaacggggcguagacguuaa

SEQ ID NO: 8419 - RNA, 1611 nt, Artificial Sequence
  VP1__Norovirus_and/or_Norovirus-like__KF429768
augaagauggcgucgagugacgccaacccaucugauggguccacagccaaccucgucccagaggccaacaaugagguuauggcuuuggagcccguuguuggugccgccauugcggcgccuguagcgggccaacaaaauguaauugaccccuggauuagaaacaauuuugugcaagccccugguggagaguuuacaguauccccuagaaacgcuccaggugaaguacuauggagcgcgcccuuaggcccugauuugaaucccuaccuuucccauuuggccagaauguacaaugguuaugcaggugguuuugaagugcagguaauccucgcggggaacgcguucgccgccggaaaaaucauauucgcagcagucccaccaaauuucucaacugaaggcuugagccccagccaggucacuauguucccccacuuaauaguagauguuaggcaacuggaaccugugaugauccccuuacccgauauuaggaauaauuucuaucauuacaaucaaucaaaugaucccaccaucaaauugauagcaauguuguauacaccucuuagggcuaauaauguuggugacgaugucuucacaguuucuugucggguacucacgagaccaucccccgauuuugauuucauauuucuagugccacccacaguugaaucaaaaaccaacccauucucuguuccaauucuaacuauugaggagaugaccaauucaagauuccccauuccuuuggaaaaguuguucacgggccccagcagugcccuuguuguucaaccacaaaacggcaggugcacgacugauggcgugcuccuggguaccacccaacugucuccugucaacaucugcaccuucagaggggaugucacccauacuacaaaaacucauaccuaccaaaugaauuuggcugcucaaaauuggaacaguuaugacccaacagaagaaaccccagccccccuaggaacuccagauuucgugggaaagauccaaggugugcucacccaaaccacgaagggaaauggcucaacccgugcccacaaagcuacaguguacacugggaccgucgaguucacuccaaaacuggguagaauccaacuuuucacugacacagacaacgaucuugaagcuaaccaaaacacaaaguucaccccagucggugucauccaggauggugaccaccaaaaugaaccccaacaauggguacucccaaguuacucagguagaaauaaucacaaugugcaccuggcccccgcuguagcccccacuuuuccgggcgagcaacuucucuucuucagauccacuaugcccggaugcagcggguaccccaacaugaauuuggacugucugcuuccccaggaaugggugcaauauuucuaucaagaggcagccccagcacaaucugauguggcuuugcuaagauuugugaauccagauacagguaggguuuuguuugagugcaagcuucauaaaucagguuaugucacaguggcccacaccggccaccaugauuugguuauccccccuaaugguuauuucagauuugauuccugggucagccccuucuacacgcuugcccccaugggaaauggaacggggcguagacguuaa

SEQ ID NO: 8420 - RNA, 1611 nt, Artificial Sequence
  VP1__Norovirus_and/or_Norovirus-like__KF806496
augaagauggcgucgaaugacgccaacccaucugauggguccgcagccaaccucgucccagaggucaacaaugagguuauggcuuuggagcccguuguuggugccgcuauugcggcgccuguggcgggccaacaaaauguaauugaccccuggauuagaaauaauuuuguacaagccccugguggagaguucacaauauccccuagaaaugcuccaggugaaauacuauggagugcacccuugggcccugauuuaaaccccuaccuuucucauuuggcuagaauguacaaugguuaugcagguggauuugaaguacaaguaguccucgcggggaaugcguucaccgccgggaaaaucauauuugcagcagucccaccaaauuuuccaacugaaggcuugagccccagccagguuacuauguucccccauauaauaguagauguuaggcaauuggaaccuguguugauucccuuacccgauguuaggaauaauuucuaucacuauaaccaaucaaaagauucuaccaucaaauugauagcaaugcuguacacaccacuuagggcuaauaaugcuggggaugaugucuucacagucucuugccgaguccucacgaggccaucccccgauuuugauuucauauucuuggugcccccuacaguugaaucaaggaccaaaccauucucugucccaguccuaacuguugaggaaaugaccaacucaagauuccccaucccccuggaaaaacuguucacaggacccagcagugcuuuuguuguccaaccacaaaauggcaggugcacgacugauggcgugcucuuaggcacuacccagcugucugcugucaacaucugcaccuucagaggggacgucacccacguugcaggugacaccuuugcaaugaauuuggcuucucuaaauuggaacaauuaugacccaacagaagaaaccccagccccucugggaacuccagauuucgugggaaggauccauggcaugcucacucaaaccacaagaagugauggcgcgacccgcgcccacaaagccacagugagcacugggggugccgacuucacuccaaagcugggcaguguccgauacagcacugacacauccggugaccuugaaguccgcgaaaacacaaaauucaccccaaucggcguccuccauuccaguggugaacgucgagcugaacccgaacaauggagacucccagaauauucaggaagaaauguucacaaugugcaucuggccccugccguugcccccaccuucccgggugagcaacuccucuucuucagauccacuaugcccggguguggcggguaccccaacauggaccuggacugccuacucccccaggagugggugcagcacuucuaccaggaagcagcgccugcacaaucugauguggcucugcugagguuugugaauccagacacagguaggguuuuguuugaaugcaagcuccauaaaucuggcuaugucacaguggcccacacuggcccgcaugauuugguuaucccccccaaugguuacuuuagauuugauuccugggucaaccaguucuacacacuugcccccaugggaaauggaacggggcguagacguuaa

SEQ ID NO: 8421 - RNA, 1611 nt, Artificial Sequence
  VP1__Norovirus_and/or_Norovirus-like__KF806499
augaagauggcgucgaaugacgccaacccaucugauggguccgcagccaaccucgucccagaggucaacaaugagguuauggcuuuggagcccguuguuggugccgcuauugcggcgccuguggcgggccaacaaaauguaauugaccccuggauuagaaauaauuuuguacaagccccugguggagaguucacaauauccccuagaaaugcuccaggugaaauacuauggagugcacccuugggcccugauuuaaaccccuaccuuucucauuuggcuagaauguacaaugguuaugcagguggauuugaaguacaaguaguccucgcggggaaugcguucaccgccgggaaaaucauauuugcagcagucccaccaaauuuuccaacugaaggcuugagccccagccagguuacuauguucccccauauaauaguagauguuaggcaauuggaaccuguguugauucccuuacccgauguuaggaacaauuucuaucacuauaaccaaucaaaagauucuaccaucaaauugauagcaaugcuguacacaccacuuagggcuaauaaugcuggggaugacgucuucacagucucuugucgaguccucacgaggccaucccccgauuuugauuucauauucuuggugcccccuacaguugaaucaaggaccaaaccauucucugucccaguccuaacuguugaggaaaugaccaacucaagauuccccaucccccuggaaaaacuguucacaggacccagcagugcuuuuguuguccaaccacaaaauggcaggugcacgacugauggcgugcucuuaggcacuacccagcugucugcugucaacaucugcaccuucagaggggacgucacccacguugcaggugacaccuuugcaaugaauuuggcuucucuaaauuggaacaauuaugacccaacagaagaaaccccagccccucugggaacuccagauuucgugggaaggauccauggcaugcucacucaaaccacaagaagugauggcgcgacccgcgcccacaaagccacagugagcacugggggugccgacuucacuccaaagcuggguaguguccgauacagcacugacacauccagugaucuugaaguccgcgaaaacacaaaauucaccccaaucggcguccuccauuccagugguggacaucgagcugaacccgaccaauggagacucccagaauauucaggaagaaauguucacaaugugcaucuggccccugccguugcccccaccuucccgggugagcaacuccucuucuucagauccacuaugcccggguguggcggguaccccaacauggaccuggacugccuacucccccaggagugggugcagcacuucuaccaggaaacagcgccagcacaaucugauguggcucugcugagguuugugaauccagacacagguaggguuuuguuugaaugcaagcuccauaaaucuggcuaugucacaguggcccacacuggcccgcaugauuugguuaucccccccaaugguuacuuuagauuugauuccugggucaaccaguucuacacacuugcccccaugggaaauggaacggggcguagacguuaa

SEQ ID NO: 8422 - RNA, 1611 nt, Artificial Sequence
  VP1__Norovirus_and/or_Norovirus-like__KF806497
augaagauggcgucgagugacgccaacccaucugauggguccgcagccaaccucgucccagaggucaacaaugagguuauggcuuuggagcccguuguuggugccgcuauugcggcgccuguggcgggccaacaaaauguaauugaccccuggauuagaaauaauuuuguacaagccccugguggagaguucacaauauccccuagaaaugcuccaggugaaauacuauggagugcacccuugggcccugauuuaaaccccuaccuuucucauuuggcuagaauguacaaugguuaugcagguggauuugaaguacaaguaguccucgcggggaaugcguucaccgccgggaaaaucauauuugcagcagucccaccaaauuuuccaacugaaggcuugagccccagccaggucacuauguucccccauauaauaguagauguuaggcaauuggaaccuguguugauucccuuacccgauguuaggaauaauuucuaucacuauaaccaaucaaaagauucuaccaucaaauugauagcaaugcuguacacaccacuuagggcuaauaaugcuggggaugacgucuucacagucucuugucgaguccucacgaggccaucccccgauuuugauuucauauucuuggugcccccuacaguugaaucaaggaccaaaccauucucugucccaguccuaacuguugaggaaaugaccaacucaagauuccccaucccccuggaaaaacuguucacaggacccagcagugcuuuuguuguccaaccacaaaauggcaggugcacgacugauggcgugcucuuaggcacuacccagcugucugcugucaacaucugcaccuucagaggggacgucacccacguugcaggugacaccuuugcaaugaauuuggcuucucuaaauuggaacaauuaugacccaacagaagaaaccccagccccucugggaacuccagauuucgugggaaggauccauggcaugcucacucaaaccacaagaagugauggcgcgacccgcgcccacaaagccacagugagcacugggggugccgacuucacuccaaagcuggguaguguccgauacagcacugacacauccagugaucuugaaguccgcgaaaacacaaaauucaccccaaucggcguccuccauuccagugguggacaucgagcugaacccgaccaauggagacucccagaauauucaggaagaaauguucacaaugugcaucuggccccugccguugcccccaccuucccgggugagcaacuccucuucuucagauccacuaugcccggguguggcggguaccccaacauggaccuggacugccuacucccccaggagugggugcagcacuucuaccaggaagcagcgccagcacaaucugauguggcucugcugagguuugugaauccagacacagguaggguuuuguuugaaugcaagcuccauaaaucuggcuaugucacaguggcccacacuggcccgcaugauuugguuaucccccccaaugguuacuuuagauuugauuccugggucaaccaguucuacacacuugcccccaugggaaauggaacggggcguagacguuaa

SEQ ID NO: 8423 - RNA, 1611 nt, Artificial Sequence
  VP1__Norovirus_and/or_Norovirus-like__JN699046
augaugauggcgucuaaggacgcuucaccaagcgcagauggcgcgaauggcgccggucagcuugugccggagguuaauaaugcugaaccacugccacuugauccaguggcgggagcuuccaccgcucuugccacugcuggacaaguuaauaugauugacccauggauuuucaauaacuuuguucaggccccucagggugaauucaccauauccccaaauaauacccccggcgauauucuguuugauuugcaauuaggcccacaccuaaauccuuuccuagcacauuugucccagauguauaauggcuggguugguaauaugcgagucagggucaucuuggcuggcaaugccuucacugcugguaaaguuauaauuuguuguguucccccuggcuuucaaucuaggacccuuucuauagcucaggccacacucuuuccccacaucauagcugaugugcgaaccuuggaaccaauugagaucccccuagaggauguuaggaauacacuuuaccauacuaaugauaaucaaccaacaaugcgucuauugugcaugcuuuacacgccacugcgcaccggugguggcucuggcgguacagaugcauuuguuguggcaggccgaguucuaacuuguccuaguucugauuuuaauuucuuguuccugguuccaccuaccguggagcagaaaacccgccccuuuagcgugccuaauauaccuuugcaguugcuuuccaauucccguguucccaaccucauacaaagcaugguccuuucacccgaucaggcccagaauguccaauuccagaauggccgcuguaccacugaugggcagcuuuuaggcacaacaccuguuucuguuagucagauuuuaaaguuuagaggaaaagugucagcuggcucuagagucaucaaucuuacugaacuggaugguucccccuuucuggcuuuugaggccccagcacccacggguuuccccgacuuggggaccagugacuggcauguugaaaugagccuuaauucaaacagccaaaguucuggcaacccaauuuuguugagggacauacaaccaaauucuucugauuuugugccacacuuggguagugugucugucaccacugcaauugauguggcuggggauuacacugguacaauccaauggacuucucaaccauccaauguuaccccagucccugaugucaacuucuggaccaucccccaguaugggucaaauuuggcagaagcuucccagcuggccccuguaguauaccccccgggguuuggugaggcuauaguguauuucauguccccuauaccaggcccuaauacagcacacaaacccaacuuggugcccugccuacucccacaagaauuugugacucauuuugucagugaacaagcuccaucuaugggugaggcagcccucguccauuauguagacccagacaccaaucgcaaccugggcgaguucaaauuguauccugaagguuucaucaccugugugccaaaugguacugguccacaacaacuuccccucaauggggucuuugucuuugccucuugggugucuagauucuaccaauuaaagccugugggaacggccagcucggccagauaa

SEQ ID NO: 8424 - RNA, 1611 nt, Artificial Sequence
  VP1__Norovirus_and/or_Norovirus-like__AM263418
augaugauggcgucuaaggacgcuucaccaagcgcagauggcgcaaauggcgccggucagcuugugccggagguuaauaaugcugaaccacugccacuugauccgguggcgggagcuuccaccgcucuugccacugcugggcaaguuaauaugauugauccauggauuuucaacaacuuuguccaggccccucagggugaauucacuauauccccaaauaacacccccggcgauauucuguuugauuugcaauuaggcccacaccuaaauccuuuccuagcacauuugucccagauguauaauggcuggguuggcaacaugcgagucagggucauccuggcuggcaaugccuuuacugcugguaaaguuauaguauguugugucccuccugguuuucaaucuaggacccuuucuauagcucaggccacgcucuuuccccacaucauagcugaugugcgaacuuuagaaccaauugagaucccccuagaggauguuaggaauacacuuuaccauaccaaugauaaucaaccaacaaugcgucuguugugcaugcuuuacacgccacugcgcaccggugguggcucuggcgguacagaugcauuuguuguggcaggccgaguucuaacuugcccuagcucugauuuuaauuucuuguuccuggucccaccuacuguggagcagaagacccgccccuuuagugugcccaauauacccuugcaguugcuuuccaauucccguguucccaaucuuauacaaagcaugguucuuucgccugaccaggcccagaauguucaauuccagaauggccgcugcacuacugaugggcagcuuuuaggcacaacaccuguuucuguuagucagauauuaaaguuuagaggaaaggugucagcuggcucuagagucauuaaucuuacugaacuggaugguucccccuucuuggcuuuugaggccccagcacccacagguuucccugacuugggaaccagugacuggcauguugaaaugagccuuaauucaaauagucaaaguucuggcaacccaauuuuauugagggacauacagccaaauucuucugauuuugugccacacuugggcaguguggcugucaccacugcaauugauguggcuggggauuacacugguacaauccaguggacuucccaaccauccaaugucaccccagucccugaugucaacuucuggaccaucccccaguacgggucaaauuuagcagaagcuucccagcuugccccuguaguguaccccccaggauuuggugaggcuauaguguacuuuaugucccccauaccaggcccuaacacagcacacaaacccaauuugguacccugccuacucccacaagaauuugugacucauuuugucagugaacaggccccauccaugggugaggcagcccucguccacuauguagacccagacaccaaccgcaacuugggcgaguucaaacuguauccugaagguuucaucacuugugugccaaaugguacugguccacaacaacuuccucuuaauggagucuuugucuuugccucuuggguguccagauucuaucaauuaaagccugugggaacggccagcucggccagauaa

SEQ ID NO: 8425 - RNA, 1611 nt, Artificial Sequence
  VP1__Norovirus_and/or_Norovirus-like__KT732278
augaugauggcgucuaaggacgcuacaccaagcgcagauggcgcgaauggcgccggucagcuugugccggagguuaauaaugcugaaccacugccacuugauccaguggcgggagcuuccaccgcucuugccacugcuggacaaguuaauaugauugacccauggauuuucaacaacuuuguucaggcuccccagggugaauuuaccauauccccaaauaauacccccggcgauauucuuuuugauuugcaauuaggcccacaccuaaacccuuuccuagcacauuuaucccagauguauaaugguuggguugguaauaugcgagucagggucaucuuggcuggcaaugccuucacugcugguaaaguuauaauuugcugugucccuccuggcuuucaaucuaggacucucucuauagcccaggcuacacucuuuccccacaucauagcugaugugcgaaccuuagaaccaauugaaaucccccuagaggauguuaggaauacauuauaucacacuaaugacaaucagccaacaaugcgccuacuaugcaugcucuacacgccacugcgcaccggugguggcucuggcgguacagacgcauuuguuguggcaggccgaguucugacuucuccuaguccugauuuuaauuucuuguuccugguuccaccuacuguggaacagaaaacccgccccuuuagugugccuaauauaccuuugcaauugcuuucuaauucccguguccccaaccuaauacaaagcaugguccucucacccgaucaggcccagaauguccaauuccagaauggccgcuguaccacugaugggcaacuuuuagguacaacaccuguuucuguuagccagauucugaaguuuagaggaaaggugucagcugguucuaaaguuauuaaucucacugaauuagaugguucccccuuucuggcuuuugaagccccagcacccacggguuuucccgauuuggggaccagugauuggcacauugagaugagccuuaauucaaauagccaaaguucuggcaauccaauuuuauuaagggacauacagccaaauucuucugacuuuguaccacacuuggguaguguggcggucacuacugcaauugauacggcuggggauuauacuggaacaauucaguggacuucccagccauccaaugucaccccagucccugaugucaacuucuggaccauuccccaguauggaucaaauuuggcagaagcuucccagcuggcccccguaguguaccccccaggauuuggugaggcuauaguauauuuuauguccccuauaccaggcccuaauacagcacacaaacccaauuuggugcccugccuacucccacaagaauuugugacccacuuuguuagugaacaagcuccaucuaugggugaggcagcucucguccacuauguagacccagacacuaaccgcaauuugggcgaguucaaauuguauccugaagguuucauuaccugugugccaaaugguacugguccacaacaacuuccccucaauggagucuuugucuuugccucuuggguuucuagauucuaccaauuaaagccugugggaacggccaacucggccagauaa

SEQ ID NO: 8426 - RNA, 1611 nt, Artificial Sequence
  VP1__Norovirus_and/or_Norovirus-like__KT732277
augaugauggcgucuaaggacgcuacaccaagcgcagauggcgcgaauggcgccggucagcuugugccggagguuaauaaugcugaaccacugccacuugauccaguggcgggagcuuccaccgcucuugccacugcuggacaaguuaauaugauugacccauggauuuucaacaacuuuguucaggcuccccagggugaauuuaccauauccccaaauaauacccccggcgauauucuuuuugauuugcaauuaggcccacaccuaaacccuuuccuagcacauuuaucccagauguauaaugguuggguugguaauaugcgagucagggucaucuuggcuggcaaugccuucacugcugguaaaguuauaauuugcugugucccuccuggcuuucaaucuaggacucucucuauagcccaggcuacacucuuuccccacaucauagcugaugugcgaaccuuagaaccaauugaaaucccccuagaggauguuaggaauacauuauaucacacuaaugacaaucagccaacaaugcgccuacuaugcaugcucuacacgccacugcgcaccggugguggcucuggugguacagacgcauuuguuguggcaggccgaguucugacuucuccuaguccugauuuuaauuucuuguuccugguuccaccuacuguggaacagaaaacccgccccuuuagugugccuaauauaccuuugcaauugcuuucuaauucccguguccccaaccuaauacaaagcaugguccccucacccgaucaggcccagaauguccaauuccagaauggccgcuguaccacugaugggcaacuuuuagguacaacaccuguuucuguuagccagauucugaaguuuagaggaaaggugucagcugguucuaaaguuauuaaucucacugaauuagaugguucccccuuucuggcuuuugaagccccagcacccacggguuuccccgauuuggggaccagugauuggcacauugagaugagccuuaauucaaauagccaaaguucuggcaauccaauuuuauuaagggacauacagccaaauucuucugacuuuguaccacacuuggguaguguggcggucacuacugcaauugauacggcuggggauuauacuggaacaauucaguggacuucccagccauccaaugucaccccagucccugaugucaacuucuggaccauuccccaguauggaucaaauuuggcagaagcuucccagcuggcccccguaguguaccccccaggauuuggugaggcuauaguauauuuuauguccccuauaccaggcccuaauacagcacacaaaccuaauuuggugcccugccuacucccacaagaauuugugacccacuuuguuagugaacaagcuccaucuaugggugaggcagcucucguccacuauguagacccagacacuaaccgcaauuugggcgaguucaaauuguauccugaagguuucauuaccugugugccaaaugguacugguccacaacaacuuccccucaauggagucuuugucuuugccucuuggguuucuagauucuaccaauuaaagccugugggaacggccaacucggccagauaa

SEQ ID NO: 8427 - RNA, 1611 nt, Artificial Sequence
  VP1__Norovirus_and/or_Norovirus-like__KJ402295
augaugauggcgucuaaggacgccccaucaagcgcagauggcgcgaauggcgccggucagcuugugccggagguuaauaaugcugaaccacugccacuugauccaguggcgggggcuuccaccgcccuugccacugcuggacaaguuaauaugauugacccauggaucuucaacaacuuuguccaggccccucagggugaauuuacuauuuccccaaauaauacccccggugauauuuuguuugauuuacaauuagguccacaucuaaauccuuuucuagcacauuuaucucaaauguauaauggcuggguuggcaauaugcggguuaggguuaucuuggccggcaaugcuuucacugcugguaaaguuauaaucuguuguguuccccccggcuuucaaucuagaacucuuucuauagcccaggcuacacucuuuccccacaucauagcugaugugcgaacucuggaaccaauugagaucccucuggaggacguuaggaauacucucuaucauacuaaugacaaucaaccaacaaugcgcuuauugugcaugcuuuacacgccacugcgcaccgguggcggcucugguggcacagaugcguuuguuguggcaggccgaguauuaacuuguccuaguucugauuuuaauuucuuauuucuagucccuccuacuguagagcagaaaacacgccccuuuaguguaccuaacauacccuugcaguugcugucuaauucccgcguccccaaucucauacaaagcaugguccuuucgccugaucaggcucagaauguccaauuucagaacggccgcugcacuaccgaugggcagcucuuggguacaacaccugucucaguuagucagauucuaaaguuuagaggaaaggugucagcuggcucuaaagucaucaaccuuacugaacuggaugguucccccuuucuagcuuuugaggccccagcacccacggguuuuccugaccugggaaccagugauuggcauguugagaugagccucaacucaaauagccagagcucuggcaacccuauuuuguugagggacauacacccaaauuccucagaauuugugccgcauuugggcagugugugugucaccgcugcaauugaagucgcuggggauuacacuggcacaauucaauggaccucucaaccaucuaacgucacuccaguccccgaugucaacuucuggaccaucccccauuauggaucaaauuuggcagaagccucccaguuggccccugugguguaccccccaggauuuggugaagcuauaguguauuuuaugucccccauaccaggcccaaacacugcacacaaacccaauuugguaccuugccuacucccacaagaauuuguaacacauuuugucagugaacaagcuccauccaugggugaggcagcccuuguccauuauguugacccagacacuaaucgcaacuugggugaguucaaauuguacccugaggguuuuaucacaugugugccgaauggcacuggcccacaacaacucccucuuaauggaguuuuugucuuugcuuccugggucuccagauuuuaucaauuaaagccugugggaacggccagcucggccagauaa

SEQ ID NO: 8428 - RNA, 1611 nt, Artificial Sequence
  VP1__Norovirus_and/or_Norovirus-like__AF414406
augaugauggcgucuaaggacgcuucaccaagcgcagauggcgcaaauggcgccggucagcuugugccggagguuaauaaugcugaaccacugccacuugauccgguggcgggagcuuccaccgcucuugccacugcugggcaaguuaauaugauugacccauggauuuucaacaacuuuguccaggccccucagggugaauucacuauauccccaaauaacacccccggcgauauccuguuugauuugcaauuaggcccgcaccuaaauccuuuccuagcacauuugucccagauguauaauggcuggguuggcaacaugcgagucagggucauccuggcuggcaaugccuucacugcugguaaaguuauaguauguugugucccuccugguuuucaaucuaggacccuuucuauagcucaggccacacucuuuccccacaucauagcugaugugcgaacuuuagaaccaauugagaucccccuagaggauguuaggaacacacuuuaucauaccaaugauaaucaaccaacaaugcgucuguugugcaugcuuuacacgccacugcgcacuggugguggcucuggcgguacagaugcauuuguuguggcaggccgaguucuaacuugcccuagcucugauuuuaauuucuuguuccuggucccacccaccguggagcagaagacccgccccuuuagugugcccaauauacccuugcaguuacuuuccaauucccguguucccaaucuuauacaaagcaugguuccuucgccugaccaggcccagaauguucaauuccagaauggccgcugcacuacugaugggcagcuuuuaggcacaacaccuguuucuguuagccagauauuaaaguuuagaggaaaggugucagcuggcucuagagucauuaaccuuacugaacuggaugguucccccuucuuggcuuuugaggccccagcacccacagguuucccugacuugggaaccagugacuggcauguugaaaugagccuuaauucaaauagucaaaguucuggcaacccaauucuauugagggacauacagccaaauucuucugauuuugugccacacuugggcaguguggcugucaccacugcaauugauguggcuggggauuacacugguacaauccaguggacuucccaaccauccaaugucaccccagucccugaugucaacuucuggaccaucccccaguacgggucaaauuuggcagaagcuucccagcuugccccuguaguguaccccccaggauuuggugaggcuauaguguacuuuaugucccccauaccaggcccuaacacagcacacaaacccaauuugguaccccgccuacucccacaagaauuugugacucauuuugucagugaacaagccccauccaugggugaggcagcucucguccacuauguagacccagacaccaaccgcaacuugggcgaguucaaacuguauccugaagguuucgucacuuguaugccaaaugguacugguccacaacaacuuccucuuaauggagucuuugucuuugccucuuggguguccagauucuaucaauuaaagccugugggaacggccagcucggccagauaa

SEQ ID NO: 8429 - RNA, 1611 nt, Artificial Sequence
  VP1__Norovirus_and/or_Norovirus-like__AB039774
augaugauggcgucuaaggacgcuacaccaagcgcagauggcgcgaacggcgccggucagcucgugccggagguuaauaaugcugaaccacugccucuugauccuguggcuggggcuucuacugccuuagcuacugcuggucaaguuaauaugauugauccuuggauuuucaauaacuuuguccaagccccucagggugaauuuacaaucuccccuaauaauacccccggugauauauuauuugauuugcaauugggaccucaccucaaucccuuccuugcccauuugucacaaauguauaaugguuggguugguaacaugcgagucagggucauccuggcagguaacgcauuuaccgccgguaaagugauaauuugcuguguccccccuggcuuccaaucuaggacccuaucaauugcucaggccacccucuuuccucaugugauugcugauguucgcacauuggaaccacuugaaaucccauuggaggauguuagaaauacacuguaccauaacaaugacagccagccgacaaugcguuuauugugcaugcuguacacgccacuucgcacugguggugguucugguggcacagacgcguuugucgucgcagggagaguuuuaacuugcccaaguccugacuucaacuuucucuuccugguccccccgacuguggaacaaaagacacgcccuuuuaguguacccaauaucccacuccagaaucuuuccaacucccgaguuccuagucugauccaaagcaugguccucucuaaugaccaugcacaaacaguccaauuccagaauggcagguguacuacugacggucaccugcuggggaccacccccguuucugcuggccagcucaugaaauucagagguaagguaacuucagguucaaaagugcuaaaccuaacagaacuagaugguucaccauuucuagccuuugaggccccagccccugcuggauuccccgaccuuggaaagugugauuggcaugucgagaugagucuuuaucaggauaacaaucaugcagacccuauugugcugcaugccauugaacccaauucaucuuccuuuguuccgcaccuuggcaguguuuccuuuaaagaaaauguuaauguagcuggugauuauguuuguacuauacaauauacuucaccccccucugauccccauaacccuaaugcugauguugauuucuggucuaucccugauuaugguuccaacuuggcugaagcaucacagcuugccccaguugucuaucccccugguuuuggugaggcuauugucuauuucaugucacgcguccccggcuggaauaggaccaacaggcucaaucuggucccuugccuguugccucaagaguucauuggacauuucgucagugaacaagcccccgcaauuggugaggccgcccucuuacauuauguugauccagauaccaaucggaaccugggugaauuuaaauuguauccugaggguuucaucacuugugucccuaauggcacuggcccucagcagcuuccccuaaauggugucuuugucuuuucuuccugggugucaagauuuuaucaacucaagccugugggaacggcuucuuuagccagauaa

SEQ ID NO: 8430 - RNA, 1611 nt, Artificial Sequence
  VP1__Norovirus_and/or_Norovirus-like__KP064095
auggcgucuaaggacgccccucaaagcgcugauggcgcaagcggcgcaggucaacuggugccggagguuaauacagcugacccuuuacccauggaaccuguggcugggccaacaacagccguagccacugcugggcaaguuaauaugauugaucccuggauuguuaauaacuuuguccagucaccucaaggugaguuuacaauuucccccaauaauacccccggugauauuuuguuugauuuacaauuagguccacaucuaaacccuuucuugucacauuugucccaaauguauaacggcuggguuggaaacaugagaguuaggauucuccuugcugggaaugcauucucagcuggaaagauuauaguuuguuguguccccccuggcuuuacaucuuccucucucaccauagcucaggcuacauuguuuccccaugugauugcugaugugagaacccuugaaccaauagaaaugccucuugaggauguacgcaauguccucuaucacaccaaugauaaucaaccaacaaugcgauuggugugcaugcuguacacgccgcuucgcacugguggggggucugguaauucugauucuuuugugguugcuggcagggugcucacagccccuaguagcgacuuuaguuucuuguuccuugucccgccuaccauagaacagaagacucgggcuuuuacugugccuaacaucccauugcaaacccuguccaauucuagguuuccuucccucauccaggggaugauucugucccccgaugcaucucaagugguccaauuccaaaaugggcguugccuuauagauggucaacucuuaggcacuacacccgcuacaucaggacagcuguucagaguaagaggaaagauaaaucagggugcccgcacacuuaaccucacagagguggaugguaaaccauuuauggcauuugauuccccugcaccugugggguuccccgauuuuggaaaaugugauuggcacaugagaaucagcaaaaccccaaacaacacaagcucaggugaccccaugcgcagugucagcgugcaaaccaaugugcaggguuuugugccacaccugggaaguauacaguuugaugaaguguucaaccacccaacaggugauuacauuggcaccauugaauggauuucccagccaucuacacccccuggaacagauauuaaucugugggagauccccgauuauggaucaucccuuucccaagcagccaaucuggcccccccagucuuccccccuggauuuggugaggcucuuguguacuuuguuucugcuuuuccgggccccaacaaccgcucagccccgaaugauguaccuugucuucuuccucaagaguacauaacccacuuugucagugaacaagccccaacgaugggugacgcagcuuuacugcauuaugucgacccugauaccaacagaaaccuuggggaauucaagcuauacccuggagguuaccucaccuguguaccaaacgggguaggugcugggccucaacagcuuccucuuaauggugucuuucucuuugucucuugggugucucguuuuuaucagcucaagccugugggaacagccaguacggcaagauaa

SEQ ID NO: 8431 - RNA, 1608 nt, Artificial Sequence
  VP1__Norovirus_and/or_Norovirus-like__AB045603
augaagauggcgucgagugacgccgcuccaucuaaugauggugcagccggucuuguaccagaggcuaacaaugagaccauggcacuugaaccgguggcuggggcuucaauagccgccccacucaccggucaaaacaauauuauagaccccuggauuagauuaaauuuugugcaggcucccaauggagaguucacgguuucaccccgcaacucgcccggggaaguccuauuaaaccuggaauuaggccccgaacuaaauccauaccuagcacaccuuucuagaauguauaaugguuaugcaggugggguugaggugcaaguacuacuggcugggaaugcguucacagcuggaaaauugguguuugccgcaguucccccucauuuuccauuagaaaacauaagcccuggccagauaacuauguucccucauguaauuauugauguuaggacuuuagaaccaguuuuguugccccuuccagauguuaggaauaauuucuuucauuauaaucagcagaaugaaccgaggaugagacucguagcaaugcuuuacacuccucuuagaucuaaugguucuggugaugauguguuuacugucuccugcagggugcuuacccgaccuuccccugauuuugauuuuaauuacuugguccccccuaccguugaaucuaaaacuaaacccuucacacucccuaucuugacuauaggggaguuaaccaacuccagguucccugugcccauagaugagcucuacaccagucccaaugagagucugguggugcaaccccagaaugggagaugcgcgcuagauggggagcugcagggcacgacucagcuccuccccacggcgauuugcucauucaggggccggaucaaucagaaggugaguggagaaaaccauguuuggaauaugcaggucaccaacaucaacgggaccccuuuugauccaacagaggaugucccggcuccucuaggcaccccagauuucucuggcaagcucuuugguguacuaagccagagggaccaugauaaugccuguaggagucaugaugcaguaauugcaaccaacucugccaaauucacuccaaaauugggcgcuauacaaauuggcacaugggaagaagacgaugugcacaucaaccaaccuacuaaguuuacuccaguuggcuuguuugaaaaugaagguuucaaccaguggacacuccccaauuacucuggagccuuaacacucaauaugggguuggccccuccuguggcccccaccuucccuggugaacaaauccuuuucuuuagaucccacauuccucuuaaaggagguguggcggacccaguuauugauugucucuugccccaagaguggauccaacaucuuuaccaagagucggccccuucacaaucagauguggcauugauuagguuuacaaauccagacacaggacguguucuauuugaagcaaaauuacacaggagugguuacauuacaguggccaauacugguagcagaccgauugugguaccagcuaaugguuacuucagguuugacucuuggguuaaucaauucuauucucucgcccccaugggaacuggaaaugggcgcagaagggugcaauaa

SEQ ID NO: 8432 - RNA, 1608 nt, Artificial Sequence
  VP1__Norovirus_and/or_Norovirus-like__AF397905
augaagauggcgucgagugacgccgcuccaucuaaugauggugcagccggucuuguaccagaggcuaacaaugagaccauggcacuugaaccgguggcuggggcuucaauagccgccccacucaccggucaaaacaauauuauagaccccuggauuagauuaaauuuugugcaggcucccaauggggaguucacgguuucaccccgcaacucgcccggggaaguccuauuaaacuuggaauuaggccccgaacuaaauccauaccuagcacaccuuucuagaauguauaaugguuaugcaggugggguugaggugcaaguacuacuggcugggaaugcguucacagcuggaaaauugguguuugccgcaguucccccucauuuuccauuagaaaacauaagcccuggccagauaacuauguucccucauguaauuauugauguuaggacuuuagaaccaguuuuguugccccuuccagauguuaggaauaauuucuuucauuauaaucaacagaaugaaccgaggaugagacucguggcaaugcuuuacacuccucuuagaucuaaugguucuggugaugauguauucacugucuccugcagggugcuuacccgaccuuccccugauuuugauuuuaauuacuugguccccccuaccguugaaucuaaaacuaaacccuucacacucccuaucuugacuauaggggaguuaaccaacuccagguucccugugcccauagaugagcucuacaccagucccaaugagagucugguggugcaaccccagaaugggagaugcgcgcuagauggggagcugcagggcacgacccagcuccuccccacggcgauuugcucauucaggggccggaucaaucagaaggugaguggagaaaaccauguuuggaauaugcaggucaccaacaucaacgggaccccuuuugauccaacagaggaugucccggcuccucuaggcaccccagauuucucuggcaagcucuuugguguacuaagccagagggaccaugauaaugccuguaggagucaugaugcaguaauugcaaccaacucugccaaauuuacuccaaaauugggcgcuauacaaauuggcacaugggaacaagacgaugugcacaucaaccaaccuacuaaguuuacuccaguuggcuuguuugaaaaugaagguuuuaaccaguggacacuccccaauuacucuggagccuuaacacuuaauaugggguuggcuccuccuguggcccccaccuucccuggugaacaaauccuuuucuuuagaucccacauuccucuuaaaggagguguggcggacccaguuauugauugucucuugccccaagaauggauccaacaccuuuaccaagagucggccccuucacaaucagauguggcauugauuagguuuacaaauccagacacaggacguguucuauuugaagcaaaauuacacaggagugguuacauuacaguggccaauacugguagcagaccgauugugguaccagcuaaugguuacuucagauuugacucuuggguuaaucaauucuauucucucgcccccaugggaacuggaaaugggcgcagaagggugcaauaa

SEQ ID NO: 8433 - RNA, 1608 nt, Artificial Sequence
  VP1__Norovirus_and/or_Norovirus-like__AF414420
augaagauggcgucgagugacgccgcuccaucuaaugauggugcagccggucuuguaccagaggcuaacaaugagaccauggcacuugaaccgguggcuggggcuucaauagccgccccacucaccggccaaaacaauauuauagaccccuggauuagauuaaauuuugugcaggcucccaauggagaguucacgguuucaccccgcaacucgcccggggaaguccuauuaaauuuggaauuaggccccgaacuaaauccauaccuagcacaccuuucuagaauguauaaugguuaugcaggugggguugaggugcaaguacuacuggcugggaaugcguucacagcuggaaaauugguguuugccgcaguucccccucauuuuccauuagaaaacauaagcccuggucagauagcuauguucccucauguaauuauugauguuaggacuuuagaaccaguuuuguugccccuuccugauguuaggaauaauuucuuucauuauaaucagcagaaugaaccgaggaugagacucguagcaaugcuuuacacuccucucagaucuaaugguucuggugaugauguauuuacugucuccugcagggugcuuacccgaccuuccccugauuuugauuuuaauuacuugguccccccuaccguugaaucuaaaacuaaacccuucacacucccuaucuugacuauaggggaguuaaccaacuccagguucccugugcccauagaugagcucuacaccagucccaaugagagucugguggugcaaccccagaacgggagaugcgugcuagauggggagcugcagggcacgacucagcuccuccccacggcgauuugcucauucaggggccggaucaaucagaaggugaguggagaaaaccauguuuggaauaugcaggucaccaacaucaacgggaccccuuuugauccaacggaggaugucccggcuccucuaggcaccccagauuucucuggcaagcucuuugguguacuaagccagagagaccaugauaaugccuguaggagucaugaugcaguaaucgcaaccaacucugccaaauucacuccaaaauugggcgcuauacaaauuggcacaugggaagaagacgaugugcacaucaaccaaccuacuaaguuuacuccaguuggcuuguuugaaaaugaagguuucaaccaguggacacuccccaauuacucuggagccuuaacacuuaauaugggguuggccccuccuguggcccccaccuucccuggugaacaaauucuuuucuuuagaucccacauuccucuuaaaggagguguggcggacccaguuauugauugccucuugccucaagaguggauccaacaucuuuaccaagagucggccccuucacaaucagauguagcauugauuagguuuacaaauccagacacaggacguguucuauuugaagcaaaauuacacaggagugguuacauuacaguggccaauacugguagcagaccgauugugguaccagcuaaugguuacuucagguuugacucuuggguuaaucaauucuauucucucgcccccaugggaacuggaaaugggcgcagaagggugcaguaa

SEQ ID NO: 8434 - RNA, 1608 nt, Artificial Sequence
  VP1__Norovirus_and/or_Norovirus-like__AF427119
augaagauggcgucgagugacgccgcuccaucuaaugauggugcagccggucucguaccagaggcuaacaaugagaccauggcacuugaaccgguggcuggggcuucaauagcugccccacucaccggccaaaacaauguuauagaccccuggauuagauuaaauuuugugcaggcucccaauggagaguucacgguuucaccccguaacucgccuggggaaauccuacuaaauuuggaauugggccccgaacugaauccauaccuggcacaccuuucuagaauguauaaugguuaugcaggugggguugaggugcaaguacuacuggcugggaacgcguucacagcuggaaaacugguguuugccgcaguucccccucauuuuccauuagaaaauauaagcccuggccaaauaacuauguucccucauguaauuauugauguuaggacuuuagagccaguucuguugccccucccagaugucaggaauaguuucuuucauuacaaucagcaaaaugaaccgaggaugagacuuguagcaaugcuuuacacuccucuuagaucuaauggcucuggugaugauguguucacugucuccugcagggugcuuacucgaccuuccccugauuuugauuuuaacuauuuaguuccaccuacuguugagucuaaaacuaaacccuucacacuccccaucuugacuauaggggagcuaaccaauuccagguucccugcgcccauagaugagcucuacaccagucccaaugagaguuugguggugcagccccaaaacgggagaugcgcgcuggacggggaguugcagggcacgacccagcuccuccccacggcgaucugcucguucaggggucgaaucaaccagaaaguaaguggagagaaccauauuuggaauaugcaggucaccaacacuaacggaaccccuuuugacccaacagaagaugucccggccccucuaggcacuccagacuucucuggcaggcucuuugguguucuuagccagagggaccacgacaaugcuuguaggagccaugaugcagugauugcaaccaacucugcuaaauucaccccaaaauugggugcuauacaaauuggcacaugggaagaagaugauguacacaucaaccaaccuaccaaauuuaccccaguuggcuuauuugaacauggagauuucaaucaguggacacuccccaacuauucuggugccuuaacacuuaauaugggauuagccccuccuguugcccccaccuuuccuggugaacaaauucucuucuuuaggucccacauuccucuuaaaggagguguggcagacccaguuauugauugucuuuugccccaggaguggauucaacaucuuuaccaagaaucagccccuucacaaucugauguagcacugauuagguucacaaauccagacacaggacguguucuauuugaggcaaaauuacauaggagugguuacauuacaguggccaauacugguagcagaccgauugugguaccagcuaaugguuacuucagauuugacucuuggguuaaucaguucuauucucuagcccccaugggaacugggaacgggcgcaggagggugcaguaa

SEQ ID NO: 8435 - RNA, 1608 nt, Artificial Sequence
  VP1__Norovirus_and/or_Norovirus-like__AB044366
augaagauggcgucgagugacgccgcuccaucuaaugauggugcagccggucuuguaccagaggcuaacaaugagaccauggcacuugaaccgguggcuggggcuucaauagccgccccacucaccggccaaaacaauauuauagaccccuggauuagauuaaauuuugugcaggcucccaauggagaguucacgguuucaccccgcaacucgcccggggaaguccuauuaaauuuggaauuaggccccgaacuaaauccauaccuagcacaccucucuagaauguauaaugguuaugcgggugggguugaggugcaaguacuacuggcugggaaugcguucacagcuggaaaacugguguuugccgcaguucccccucauuuuccauuagaaaauauaagcccuggccagauaacuauguucccucauguaauuauugauguuaggacuuuagaaccaguuuuguugccccuuccugauguuaggaauaauuucuuucauuauaaucagcagaaugaaccgaggaugagacuuguagcaaugcuuuauacuccucuuagaucuaaugguucuggugaugauguauucacugucuccugcagggugcuuacccgaccuuccccugauuuugauuuuaauuauuugguccccccuacuguugaaucuaaaaccaaacccuucacacucccuaucuugacuauaggggaguuaaccaacuccagguucccuguaccuauagaugagcucuacaccagucccaaugagagucugguggugcaaccccagaacgggagaugcgcacuagauggggagcugcagggcacgacucagcuccuccccacggcgaucugcucguucaggggccggaucaaucagaaggugaguggggaaaaccauguuuggaauaugcaggucaccaacaucaacgggaccccuuuugauccaacagaggaugucccggcuccucuaggcacuccagauuucucuggcaagcucuuugguguacuaagccagagagaccaugauaaugccugcaggagucaugaugcaguaauugcaaccaacucugccaaauuuaccccaaaauugggcgcuauacaaauuggcacaugggaagaagacgaugugcacaucaaccaaccuacuaaguuuacuccaguuggcuuguuugaagauggagguuucaaccaguggacacuccccaauuauucuggagccuuaacacuuaauaugggauuggccccuccuguggcccccaccuucccuggugaacaaauucuuuucuuuagaucccacauuccucuuaaaggagguguggcggacccaguuauugauugucucuugccucaagaauggauccaacaucuuuaccaagagucggcccccucacaaucagauguagcacugauuagguuuacaaauccagacacaggacguguucuauuugaagcaaaauuacacaggagugguuacaucacaguggccaauacugguagcagaccgauugugguaccagcuaaugguuacuucagguuugacucuuggguuaaucaauucuauucucuugcccccaugggaacuggaaaugggcgcagaagggugcaguaa

SEQ ID NO: 8436 - RNA, 1608 nt, Artificial Sequence
  VP1__Norovirus_and/or_Norovirus-like__AB032758
augaagauggcgucgaaugacgccgcuccaucuaaugauggugcagccggucuuguaccagaggcuaacaaugagaccauggcacuugaaccgguggcuggggcuucaauagccgccccacucaccggccaaaacaauauuauagaccccuggauuagauuaaauuuugugcaggcucccaauggagaguucacgguuucaccccgcaacucacccggggaaguccuauuaaauuuggaauuaggccccgaacuaaauccauaccuagcacaccuuucuagaauguauaaugguuaugcaggugggguugaggugcaaguacuacuggcugggaaugcguucacagcuggaaaauugguguuugccgcaguucccccucauuuuccauuagaaaacauaagcccuggucagauaacuauguuuccucauguaauuauugauguuaggacuuuagaaccaguuuuguugccccuuccugauguuaggaauaauuucuuucauuauaaucagcagaaugaaccgaggaugagacucguagcaaugcuuuauacuccucuuagaucuaaugguucuggugaugauguauuuacugucuccugcagggugcuuacccgaccuuccccugauuuugauuuuaauuacuugguccccccuacccuugaaucuaaaacuaaacccuucacacucccuaucuugacuauaggggaguuaaccaacuccagguucccugugcccauagaugagcucuacaccagccccaaugagagucugguggugcaaccccagaacgggagaugcgcgcuagauggggagcuacagggcacgacucagcuccuccccacggcgauuugcucguucaggggccggaucaaucaaaaggugaguggagaaaaccauguuuggaauaugcaggucaccaacaucaacgggaccccuuuugauccaacaggggaugucccggcuccucuaggaaccccagauuucucuggcaagcucuuugguguacuaagccagagagaccaugauaaugccuguaggagucaugaugcaguaauugcaaccaacucugccaaauucacuccaaaauugggcgcuauacaaauuggcacaugggaagaagacgaugugcacaucaaccaaccuacuaaguuuacuccaguuggcuuguuugaaaaugaagguuucaaccaguggacacuccccaauuauucuggagccuuaacacuuaauaugggguuggccccuccuguggcccccaccuucccuggugaacaaauucuuuucuuuagaucccacauuccucuuaaaggagguguggcggacccaguuauugauugucucuugccucaagaguggauccaacaucuuuaccaagagucggccccuucacaaucagauguagcauugauuagguuuacaaauccagacacaggacguguucuauuugaagcaaaauuacacaggagugguuacauuacaguggccaauacugguagcagaccgauugugguaccagcuaaugguuacuucagguuugauacuugggucaaucaauucuauucucucgcccccaugggaacuggaaaugggcguagaaggguucaguaa

SEQ ID NO: 8437 - RNA, 1608 nt, Artificial Sequence
  VP1__Norovirus_and/or_Norovirus-like__AB039775
augaagauggcgucgagugacgccgcuccaucuaaugauggugcagccggucuuguaccagaggcuaacaaugagaccauggcacuugaaccgguggcuggggcuucaauagccgccccacucaccggucaaaacaauauuauagaccccuggauuagauuaaauuuugugcaggcucccaauggggaguucacgguuucaccccgcaacucgcccggggaaguccuauuaaacuuggaauuaggccccgaacuaaauccauaccuagcacaccuuucuagaauguauaaugguuaugcaggugggguugaggugcaaguacuacuggcugggaaugcguucacagcuggaaaauugguguuugccgcaguucccccucauuuuccauuagaaaacauaagcccuggccagauaacuauguucccucauguaauuauugauguuaggacuuuagaaccaguuuuguugccccuuccagauguuaggaauaauuucuuucauuauaaucagcagaaugaaccgaggaugagacucguggcaaugcuuuacacuccucuuagaucuaaugguucuggugaugauguauuuacugucuccugcagggugcuuacccgaccuuccccugauuuugauuuuaauuacuuggucccuccuaccguugaaucuaaaacuaaacccuucacacucccuaccuugacuauaggggaguuaaccaacuccagguucccugugcccauagaugagcucuacaccagucccaaugagagucugguggugcaaccccagaaugggagaugcgcgcuagauggggagcugcggggcacgacucagcuccuccccacggcgauuugcccauucaggggccggaucaaucagaaggugaguggagaaaaccauguuuggaauaugcaggucaccaacaucaacgggaccccuuuugauccaacagaggaugucccggcuccccuaggcaccccagauuucucuggcaagcucuuugguguacuaagccagagggaccaugauaaugccuguaggagucaugaugcaguaauugcaaccaacucugccaaauuuacuccaaaauugggcgcuauacaaauuggcacaugggaagaagacgaugugcacaucaaccaaccuacuaaguuuacuccaguuggcuuguuugaaaaugaagguuucaaccaguggacacuccccaauuacucuggagccuuaacacuuaauaugggguuggccccuccuguggcccccaccuucccuggugaacgaauccuuuucuuuagaucccacauuccucuuaaaggagguguggcggacccaguuauugauugucucuugcaccaagaguggauccaacaucuuuaccaagagucggccccuucacaaucagauguggcauugauuagguuuacaaauccagacacaggacguguucuauuugaagcaaaauuacacaggagugguuacauuacaguggccaauacugguagcagaccgauugugguaccagcuaaugguuacuucagguuugacucuuggguuaaucaauucuauucucucgcccccaugggaacuggaaaugggcgcagaagggugcaauaa

SEQ ID NO: 8438 - RNA, 1608 nt, Artificial Sequence
  VP1__Norovirus_and/or_Norovirus-like__AF414418
augaagauggcgucgaaugacgccgcuccaucuaaugauggugcagccggucucguaccagaggucaacaacgagacgauggcacucgaaccgguggcuggggcuuccauagccgccccucuaaccggucaaaacaacgugauagaccccuggauuagaaugaacuuuguucaagccccaaauggugaauuuacaguaucuccccguaacucuccuggugaaauucuguuaaauuuagaauuagguccuggauuaaauccauucuuagcacaccuuucaaggauguacaaugguuaugcuggcgggguugaagugcaggugcuacuugcugggaacgcguucacagcaggaaaacuaguguuugcagcaauccccccacauuucccuauugagaaccuuaguccuggacagaucacaauguucccccaugugaucauugauguuaggacauuagaacccguacuuuugccccucccagauguuaggaauaauuucuuucauuauaaucaggagccugagccccguaugaggcuuguggcuauguuguauaccccccuuaggucuaaugguucuggugaugauguguuuacaguuucuuguaggguucuuacucgcccuuccccagauuuugauuucaauuauuugguucccccaacuguugagucuaaaaccaaaccauucacccuaccaauucugaccauuggagaguugucaaauucuagguucccagcuccaauugacgaacuguauaccagucccaaugagggcuugguuguucaaccccaaaacggcagaucaacacucgauggugaauuguugggcaccacucaacucgugcccucaaacaucugcucacugcgaggacgcaucaaugcccacuugucagauaaccagcaccguuggaacaugcaggucacaaaugcaaauggaacucccuucgaccccaccgaagauguccccgcaccacuaggcacaccagacuuccuagcgaacaucuauggagucaccagccagaggaaccccgacaacacuugucgcgcccaugauggaauuuuggcgacuuggagccccaaauuuacaccuaagcuagggucugugguccugggcacuugggaagacagagauuuugacauaaaccaacccacgagguuuacaccuguugguuuguaugauacugaucacuuuaaucaaugggcuuuaccaaauuauucuggagcgcugacucuaaacaugaauuuggcacccucugucgccccucucuuuccaggugagcagcuacuuuucuucaggucccauauaccacucaaaggagguaccucuaauggugcuauugauugucuacucccccaggaauggguucagcacuuuuaccaggagucagcuccauccucuacugacguggcucuaaucagguacaccaacccugacacaggacgcguuuuguuugaggccaaauugcacaggcagggauuuaucacaguggcaaacucugguucuagacccauuguuguccccccaaauggcuauuuuagauuugauucuuggguuaaucaguuuuacucucuugcccccaugggaacugggaaugggcgcagaagagugcaguaa

SEQ ID NO: 8439 - RNA, 1608 nt, Artificial Sequence
  VP1__Norovirus_and/or_Norovirus-like__AF425769
augaagauggcgucgaaugacgccgcuccaucuaaugauggugcagccggucucguaccagaggucaacaacgagacgauggcacucgaaccgguggcuggggcuucuauagccgccccucuaaccggucagaauaaugugauagaccccuggauuagaaugaacuuuguucaagccccaaauggugaauucacaguaucuccccguaauucuccuggugaaauuuuguugaauuuagaauuagguccugaauuaaauccauucuuagcgcaccuuucaaggauguauaaugguuaugcuggcgggguugaagugcaggugcuacuugcugggaacgcguucacagcaggaaaacuaguguuugcagcaauccccccacauuucccuauugagaaccuuagccccggacaaauuacaauguucccccaugugaucauugauguuaggacuuuagaaccuguacuuuugccucucccggacguuaggaacaacuucuuucauuauaaccaggagccugagccccguaugaggcuuguggcuaugcuguauaccccccuuaggucuaaugguucuggugaugauguguuuacaguuucuuguaggguucuuacucgcccuuccccagauuuugauuucaauuauuugguucccccaacuguugagucuaaaaccaaaccauucacccuaccaauucugaccauuggagaauugucaaauucuagguucccagcuccaauugaugaacuguauaccagucccaaugagggcuugguuguccaaccccaaaacggcagaucaacacucgacggugaauuguugggcaccacucaacucgugcccucaaacaucugcucacugcgaggacgcaucaaugcccacuugucagauaaucagcaccguuggaauaugcaggucacaaauguaaauggaacucccuucgaccccaccgaagaugucccugcaccacuggguacaccagacuuccuagcgaacaucuauggagucaccagccagaggaaccccgacaacacuugucgcgcccaugauggaauuuuggcgacuuggagccccaaauuuacacccaaacuagggucugugguccugggcacuugggaagacagagauuuugacauaaaccaacccacgagguuuacaccuguugguuuguaugacacugaucacuuuaaucaaugggcuuuaccaaauuacucuggagcgcugacucuaaacaugaauuuggcacccucugucgccccucucuuuccaggugagcagcuacucuucuucagaucccauauaccacucaaaggaggcaccucuaauggugcuauugauuguuuacucccccaggaauggguucagcacuuuuaccaggaaucagcuccauccuccacugacguggcucuaaucagguacaccaacccugacacaggacgcguuuuguuugaggccgaauugcacaggcagggauuuaucacaguggcaaauccuggcucuagacccauuguuguccccccaaaugguuauuuuagauuugauucuuggguuaaucaguuuuauucucuugcccccaugggaacugggaaugggcgcagaagaguacaguaa

SEQ ID NO: 8440 - RNA, 1608 nt, Artificial Sequence
  VP1__Norovirus_and/or_Norovirus-like__AF414421
augaagauggcgucgaaugacgccgcuccaucuaaugauggugcagccggucucguaccagaggucaacaacgagacgauggcacucgaaccgguggcuggggcuuccauagccgccccucuaaccggucaaaacaaugugauagaccccuggauuagaaugaacuuuguucaagccccaaauggugaauuuacagugucuccccguaacucuccuggugaaauucuguuaaauuuagaauuagguccugaauuaaauccauucuuagcacaccuuucaaggauguacaaugguuaugcuggcgggguugaagugcaggugcuacuugcugggaacgcguucacagcgggaaaacuaguguuugcagcaauccccccacauuucccuauugagaaccuuaguccuggacaaauuacaauguucccccaugugaucauugauguuaggacauuagagccuguacuuuugccccucccagauguuaggaauaauuucuuccauuacaaucaggagccugagccccguaugaggcuuguggcuaugcuguauaccccccuuaggucuaaugguucuggugaugauguguuuacaguuucuuguaggguucuuacucgcccuuccccagauuuugauuucaauuauuugguucccccaacuguugagucuaaaaccaaaccauucacccuaccaauucugaccauuggagaauugucaaauucuagguucccagcuccaauugacgaacuguauaccagucccaaugagggcuugguuguucaaccccaaaacggcagaccaacacucgacggugaauuguugggcaccacucaacucgugcccucaaauauuugcucacugcgaggacgcaucaacgcccacuugucagauaaccagcaccguuggaacaugcaggucacaaaugcaaauggaacucccuucgaccccaccgaagaugccccugcaccacugggcacaccagacuuccuagcgaacaucuauggagucaccagccagaggaaccccgacaacacuugucgcgcccaugauggaauuuuggcgacuuggagccccaaauuuacacccaaacuagggucugugguccugggcacuugggaagacagagacuuugauauaaaccaacccacgagauuuacaccuguugguuuguaugauacugaucacuuuaaucaaugggcuuuaccaaauuauucuggagcgcugacucuaaacaugaacuuggcacccucugucgcuccucucuuuccaggugagcagcuacuuuucuucaggucccacauaccacucaaaggagguaccucuaauggugcuauugauugucuacucccccaggaauggguucagcacuuuuaccaggagucagcuccauccucuacugacguggcucuaaucagguauaccaacccugacacagggcgcguuuuguuugaggcuaaauugcacaggcagggauuuaucacaguggcaaacucuggcucuagaccuauuguuguccccccaaauggcuacuuuagauuugacucuugggucaaucaguuuuauucucuugcccccaugggaacugggaaugggcgcagaagaguacaguaa

SEQ ID NO: 8441 - RNA, 1608 nt, Artificial Sequence
  VP1__Norovirus_and/or_Norovirus-like__AF414416
augaagauggcgucgaaugacgccgcuccaucuaaugauggugcagccggucucguaccagaggucaacaacgagacgauggcacucgaaccgguggcuggggcuuccauagccgccccucuaaccggucaaaacaaugugauagaccccuggauuagaaugaacuuuguucaagccccaaauggugaauuuacaguaucuccccguaacucuccuggugaaauucuguuaaauuuagaauuagguccugaauuaaauccauucuuagcacaccuuucaaggauguauaaugguuaugcuggcgggguugaagugcaggugcuacuugcugggaacgcguucacagcaggaaaacuaguguuugcagcgauccccccacacuucccuauugggaaucuuaguccuggacaaauugcaauguucccccaugugaucauugauguuaggacauuagaaccuguacuuuugccccucccagauguuaggaauaauuucuuccacuacaaccaggagccugagccccguaugaggcuuguggcuauguuguauaccccccuuaggucuaaugguucuggugaugauguguuuacaguuucuuguaggguucuuacucgcccuuccccagauuuugauuucaauuacuugguucccccaacuguugagucuaaaaccaaaccauucacccuaccaauccugaccauuggagaauugucaaauucuagguucccaguuccaauugaugaacuguauaccagccccaaugagggauugguuguucaaccccaaaacggcagaucaacacucgacggugaauuguugggcaccacucaacucgugcccucaaacaucuguucacugcgaggacgcaucaaugcccacuugucagauaaccaacaccguuggaacaugcaggucacaaaugcaaauggaacccccuucgaccccaccgaagaugucccugcaccacugggcacaccagacuuccuagcgaacaucuauggagucaccagccagaggaaccccgacaacacuugucgcgcccaugauggaauuuuggcgacuuggagccccaaauuuacacccaaauuagggucugugguucuggguacuugggaagauagagauuuugauauaaaccaacccacgagguuuacaccuguugguuuguaugauacugaucauuuuaaucaauggguuuuaccguauuauucuggagcgcugacccuaaacaugaauuuggcacccucugucgcuccucucuuuccaggugagcaacuacuuuucuucaggucccauguaccacucaaaggagguaccucuaauggugccauugauugucuacucccccaggaauggguucagcacuuuuaccaggagucagcuccauccucuacugacguggcucugaucagguacaccaacccugacacaggacgcguuuuguucgaggccaaauugcacaggcagggauuuaucacaguggcaaacucuggcucuagacccauuguugucccccccaauggcuauuuuagauuugauucuuggguuaaccaguuuuauucucuugcccccaugggaacugggaaugggcgcagaagaguacaguaa

SEQ ID NO: 8442 - RNA, 1608 nt, Artificial Sequence
  VP1__Norovirus_and/or_Norovirus-like__AF414419
augaagauggcgucgaaugacgccgcuccaucuaaugauggugcagccggucucguaccagaggucaacaacgagacgauggcacucgaaccgguggcuggggcuuccauagccgccccucuaaccggucaaaacaaugugauagaccccuggauuagaaugaauuuuguucaagccccaaauggugaauuuacagugucuccccguaacucuccuggugaaauucuguuaaauuuagaauuagguccugaauuaaauccauucuuagcacaccuuucaaggauguacaaugguuaugcuggcgggguugaagugcaggugcuacuugcugggaacgcguucacagcaggaaagcuaguguuugcagcaauccccccacauuucccuauugagaaccuuaguccuggacaaauuacaauguucccccaugugaucauugauguuaggacauuagaaccugugcuuuugccccucccagauguuaggaauaauuucuuucauuauaaucaggagccugagccccguaugagacuuguggcuaugcuguauaccccacuuaggucuaaugguucuggugaugauguguuuacaguuucuuguaggguucuuacucgcccuuccccagauuuugauuucaauuauuugguucccccaacuguugagucuaaaaccaaaccauucacccuacuaauucugaccauuggagaauugucaaauucuagauucccagcuccaauugacgaacuguauaccagucccaaugaggguuugguuguucaaccccaaaacggcagaucaacacucgauggugaauuguugggcaccacucaacucgugcccucaaacaucugcucacuacgaggacgcaucaaugcccacuugucagauaaccagcaccguuggaacaugcaggucacaaaugcaaauggaacucccuucgaccccacugaagaugucccugcaccacugggcacaccagacuuccuagcgaacaucuauggagucaccagccagaggaaccccgacaacacuugucgcgcccaugauggaauuuuggcgacuuggagccccaaauuuacacccaagcuagggucugugguccugggcacuugggaagacagagauuuugacauaaaccaacccgcgagguuuacaccuguugguuuguaugauacugaucacuuuaaucaaugggcuuuaccaaauuauucuggagcgcugacucuaaacaugaauuuggcacccucugucgccccucucuuuccaggugagcagcuacuuuucuucaggucccauauaccacucaaaggagguaccucuaauggugcuauugauugucuacucccccaggaauggguucaacacuuuuaccaggagucagcuccauccucuacugacguggcucuaaucagguacaccaacccugacacaggacgcguuuuguuugaggccaaauugcacaggcagggauuuaucacaguggcaaacucuggcucuagacccauuguugucccuccaaauggcuauuuuagauuugauucuuggguuaaucaguuuuacucucuugcccccaugggaacugggaaugggcgcagaagagugcaguaa

SEQ ID NO: 8443 - RNA, 1608 nt, Artificial Sequence
  VP1__Norovirus_and/or_Norovirus-like__AF425767
augaagauggcgucgaaugacgccgcuccaucuaaugauggugcagccggucucguaccagaggucaacaacgagacgauggcacucgaaccgguggcuggggcuucuauagccgccccucuaaccggucagaacaaugugauagaccccuggauuagaaugaacuuuguucaagccccaaauggugaauucacaguaucuccccguaauucuccuggugaaauuuugcugaauuuagaauuagguccugaauuaaauccauucuuagcgcaccuuucaaggauguauaaugguuaugcuggcgggguugaagugcaggugcuacuugcugggaacgcguucacagcaggaaaacuaguguuugcagcaauccccccacauuucccuauugagaaccuuagccccggacaaauuacaauguucccccaugugaucauugauguuaggacuuuagaaccuguacuuuugccucucccggauguuaggaacaacuucuuucauuauaaucaggauccugagccccguaugaggcuuguggcuaugcuguauaccccccuuaggucuaaugguucuggugaugauguguuuacaguuucuuguaggguucuuacucgcccuuccccagauuuugauuuuaauuauuugguucccccaacuguugagucuaaaaccaaaccauucacccuaccaauucugaccauuggagaauugucaaauucuagguucccagcuccaauugaugaacuguauaccagucccaaugagggcuugguuguccaaccccaaaacggcggaucaacacucgacggugaauuguugggcaccacucaacucgugcccucaaacaucugcucacugcgaggacgcaucaaugcccacuugucugauaaucagcaccguuggaauaugcaggucacaaauguaaauggaacucccuucgaccccaccgaagaugucccugcaccacugggcacaccagacuuccuagcgaacaucuauggaaucaccagccagaggaaccccgacaacacuugucgcgcccaugauggaauuuuggcgacuuggagccccaaauuuacacccaaacuagggucugugguccugggcacuugggaagacagagauuuugacauaaaccaacccacgagguuuacaccuguugguuuguaugauacugaucacuuuaaucaaugggcuuuaccaaauuacucuggagcgcugacucuaaauaugaauuuggcacccucugucgccccucucuuuccaggugagcagcuacucuucuucaggucccauauaccacucaaaggaggcaccucuaauggugcuauugauuguuuacucccccaggaauggguucagcacuuuuaccaggaaucagcuccauccuccacugacguggcucuaaucagguacaccaacccugacacaggacgcguuuuguuugaggccaaauugcacaggcagggauuuaucacaguggcaaacucuggcucuagacccauuguuguccccccaaaugguuauuuuagauuugauucuuggguuaaucaguuuuauucucuugcccccaugggaacugggaaugggcgcagaagaguacaguaa

SEQ ID NO: 8444 - RNA, 1608 nt, Artificial Sequence
  VP1__Norovirus_and/or_Norovirus-like__DQ093065
augaagauggcgucgaaugacgccgcuccaucuaaugauggugcagccggucucguaccagaggucaacaacgagaugauggcacucgaaccgguggcuggggcuuccauagccgccccucuaaccggucaaaacaaugugauagaccccuggauuagaaugaauuuuguccaagccccaaauggugaauuuacagugucuccccguaacucuccuggugaaauucuguuaaauuuagaauuagguccugaauuaaauccauucuuagcacaccuuucaaggauguacaaugguuaugcuggugggguugaagugcaggugcuacuugccgggaacgcguucacagcaggaaaacuaguguuugcagcaauucccccacguuucccuauugagaaccuuaguccugggcaaauuacaauguucccccaugugaucauugauguuaggacauuagaaccuguacuuuugccccucccagauguuaggaauaauuucuuucauuauaaucaggagccugagccccguaugaggcuuguugcuaugcuguauaccccccuuaggucuaaugguucuggugaugauguguuuacaguuucuuguaggguucuuacucgcccuuccccagauuuugauuucaauuauuugguucccccaacuguugagucuaaaacuaaaccauucacccuaccaauccugaccauuggagaauugucaaauucuagguucccagcuccaauugaugaacuguauaccagucccaaugaggguuugguuguccaaccccaaaacggcagaucaacacucgacggugaacuguugggcaccacccaacucgugcccucaaacauuugcucacugcgaggacgcaucaaugcccacuugccagacaaccagcaccguuggaacaugcaggucacaaaugcaaauggaacucccuucgaccccaccgaagauguuccugcaccgcuggguacaccagacuuccuagcgaacaucuauggagucaccagucagaggaaccccgacaacacuugucgcgcccaugauggaauuuuggcgacuuggagccccaaauucacaccuaaacuggggucugugguccugggcacuugggaagacagagauuuugacauaaaccaacccacgagguuuacaccuguugguuuguaugacacugaucacuuuaaucaaugggcuuuaccaaauuauucuggagcgcugacucuaaacaugaauuuggcacccucugucgccccccucuucccaggugagcaguuacuuuucuucaggucccauauaccacucaaaggaggcaccucuaauggugcuauugauugucuacucccucaggaauggguucagcacuuuuaccaggagucagcuccauccucuacugacguggcucugaucagguacaccaacccugacacaggacgcguuuuguuugaggccaaauugcacaggcagggauuuaucacaguggcaaacucuggcuccagacccauuguuguccccccaaauggcuauuuuagauuugauucuuggguuaaucaauuuuauucucuugcccccaugggaacugggaacgggcgcagaagagugcaguaa

SEQ ID NO: 8445 - RNA, 1608 nt, Artificial Sequence
  VP1__Norovirus_and/or_Norovirus-like__KJ194507
augaagauggcgucgaaugacgccgcuccaucuaaugauggugcagccggucucguaccagaggucaacaacgagacgauggcacuugaaccgguggcuggggcuuccauagcugccccccuaaccggucaaaacaaugugauagaccccuggauuagaaugaacuuuguucaagccccaaauggugaauuuacagugucuccccguaauuccccaggugaaguauugcuaaauuuggaauuagguccugaacugaauccauucuuggcgcaccuuucgagaauguacaaugguuaugcaggcgggguugaagugcaggugcugcuugcugggaaugcguucacagcagggaaacugguauuugcagcaaucccuccgcauuucccucuugagaauuugaguccuggacaaauuaccauguucccucauguaauuauugauguuagaacacuagaaccuguucuuuuaccucucccagauguuagaaauaauuucuuucauuauaaucagcaacccgagccccguaugaggcuuguggcuauguuguauacuccucuuagaucuaauggcucuggugaugauguguucacaguuucuuguaggguccuuacccgcccuucuccagauuuugauuucaauuauuugguccccccaacuguggagucuaaaaccaaaccauuuacccugccaaucuugacuauuggagaauugucaaauucuagguucccagucccaauagaugaauuguacaccagucccaaugaaggagugguugugcaaccucaaaaugguagaucaacacucgauggugaguugcugggcacuacacaacuuguacccucaaacaucugugcguugcgagggcguaucaaugcccaagugccagaugaccaccaucaauggaacuugcaggucacaaauacaaaugggacucccuucgaucccaccgaagacgucccugcaccauugggcacgccggacuuccuggcaaacauuuauggaguuaccagucagagaaaccccaacaacacuugccgugcccacgauggggucuuggcaaccuggagcccuaaauuuacacccaaauuagggucuguuguucugggcacuugggaagaaagugaccuugaccuuaaucaacccacaagauucacaccuguuggcuuguuuaauacagaccacuucgaucaguggguucuaccuaacuauucuggaagacugaccuugaauaugaauuuggcacccucuguguccccccucuuuccaggugagcaaauacucuucuuuaggucccauauaccacucaaggggggcacuucugacggugccauugacugcuugcucccccaagaauggauucagcauuuuuaccaggaaucagccccgucgcccacggacguggcucuaauuagguacaccaauccugauacgggucgaguuuuguuugaggcuaaauuacacaggcaaggauucaucacaguggcaaauucuggcucuaggccuauuguuguuccuccuaauggcuauuuuagauuugauucuuggguuaaucaguuuuauucucuugcccccaugggaacugguaaugggcgcagaagggugcaguaa

SEQ ID NO: 8446 - RNA, 1608 nt, Artificial Sequence
  VP1__Norovirus_and/or_Norovirus-like__KP064099
augaagauggcgucgaaugacgccgcuccaucuaaugauggugcagccggucucguaccagaggucaacaaugagaccauggcccuugaaccgguggcuggggcuucaauagccgccccacucaccggucaaaauaauguuauagaccccuggauuagauuaaacuuugugcaggcucccaauggagaguuuacaguuucaccccgcaauucgccuggggaaguccugcuaaacuuggaauuaggcccugaacuaaauccauauuuggcacaccuuuccagaauguacaaugguuaugcagguggaguugaggugcaaguacuacuggcugggaacgcguucacggcuggaaaacugguauucgccgcaguucccccucauuuuccauuagaaaacauaagcccuggccaaauaaccauguucccucauguaauuauugauguuaggacuuuagaaccaguccuauugccucuuccagauguuaggaacaauuucuuucacuauaaucagcaaaacgaaccaaggaugaggcuuguggcaaugcucuauaccccccuuagaucuaaugguucuggugaugauguauuuacugucucauguagagugcuuacucgacccucuccugauuuugauuucaauuauuugguacccccuacaguugaaucuaaaacuaaacccuucacacucccuaucuugaccauaggggaguuaaccaauuccagauucccugugccuauagaugaacucuauacuagccccaaugagaguuuggugguacaaccccagaacgggagaugugcgcuggacggggaguugcaggguacuacucagcuccuccccacggcgaucugcucguucaggggucggauuaaucagaaagugaguggagauaaccauguuuggaauaugcaagucaccaacauuaacggaaccccuuuugauccaacagaggauguuccagcuccucuagguacaccagacuuuucuggcaagcucuuuggcgucuuaagccagagggaccaugauaaugccuguaggagccaugaugcagugauugcaacugauucugcuaaauuuaccccaaaauugggcgcuauacaaauuggcacaugggaagaagaugauguacacaucaaccaacccaccaaguuuacuccaguuggcuuguucgaaagagaagguuuuaaucaguggacacucccuaacuauucuggagccuuaacacucaauaugggguuggcccccccuguggcccccacauuuccuggugagcaaauucuuuucuucagaucccacauuccucucaaaggagguguggcagacccaguuauugauugucucuugccccaagaguggauccaacaccuuuaccaggagucagccccuucacaaacagauguagcacugaucagauucacaaauccagacacagggcguguccuauuugaagcaaaauugcacaggaguggcuacaucacaguggccaauacugguagcagaccaauuguggugccagcuaaugguuacuucagguuugacucuuggguuaaucaguuuuauucucucgcccccaugggaacugggaaugggcgcagaagggugcaguaa

SEQ ID NO: 8447 - RNA, 1608 nt, Artificial Sequence
  VP1__Norovirus_and/or_Norovirus-like__AB303926
augaagauggcgucgaaugacgccaccccaucugauggguccacagccaaccucgucccagaggucaacaaugaggucauggcuuuggagcccguuguuggugccgcuauugcggcacguguagcgggccaacaaaauguaauugaccccuggauuagaaauaauuuuguacaagccccugguggagaguuuacaguguccccuagaaacgcuccgggugagauacuauggagcgcgcccuugggcccugaucugaaccccuaccuuucccauuuggccagaauguacaaugguuaugcaggugguuuugaagugcagguaauccucgcggggaacgcguucaccgccgggaaaaucauauuugcagcagucccaccaaauuuuccaacugaaggcuugagccccagccaggucacuauguucccccauauaauaguagauguuaggcaauuggaaccugugcugauccccuuaccugauguuaggaauaauuucuaucauuacaaucaaucaaaugauucuaccauuaaauugauagcaaugcuguauacaccacuuagggcuaauaaugcuggggaugaugucuucacagucucuugucgaguccucacgaggccaucccccgacuuugacuucauauucuuggugccacccacaguugaaucaagaacuaaaccauucaccgucccaaucuuaacuguugaggaaauguccaauucaagauuccccguuccuuuggaaaaguuguacacgggucccagcagugcuuuuguuguccaaccacaaaauggcaggugcacgacugauggcgugcucuuaggcaccacccagcugucugcugucaacaucugcaccuucagaggggaugucacccacauugcaggcagucaugauuauacaaugaauuuggcuucucaaaauuggaacaauuaugacccaacagaagaaaucccagccccucugggaaccccagauuucgugggaaagauccaaggcgugcucacccaaaccacaagagaggauggcucgacccgcgcccacaaagcuacagugagcacugggaguguccacuuuacuccaaagcugggcaguguucaauacaccacugacacaaacaaugauuuucaaacuggccaaaacacgaaauucaccccagucggcgucauccaggacgguaguaaccaucaaaaugaaccccaacaaugggugcucccaaacuacucagguagaacuggccauaaugugcacuuagccccugccguugcccccacuuuuccgggugagcaacuucuuuucuuuagguccacuaugcccggauguagcggguaucccaauaugaaucuggauugccuacucccccaggaaugggugcagcacuucuaccaagaagcagcuccagcacaaucugauguggcucugcugagauuugugaauccagacacagguaggguucuguuugagugcaaacuccauaaaucaggcuaugucacaguggcucacacuggcccgcaugauuugguuaucccccccaaugguuauuuuagauuugauucuugggucaaucaguucuacacacuugccccuaugggaaauggagcggggcguuaa

SEQ ID NO: 8448 - RNA, 1608 nt, Artificial Sequence
  VP1__Norovirus_and/or_Norovirus-like__KU985166
augaagauggcgucgagugacgccaacccaucugauggguccacagccagccucgucccagaggucaacaaugagguuauggcuuuggagcccguaguuggugccgcuauugcggcaccuguagcgggccaacaaaauguaauugaccccuggauuagaaacaauuuuguacaagccccugguggagaguuuacaguauccccuagaaacgcuccaggugaaauacuauggagcgcgccuuuaggcccugauuugaaucccuaccuuucccauuuggccagaauguauaaugguuaugcaggugguuuugaagugcagguaauccucgcggggaacgcguucacugccgggaaaauuauauuugcagcagucccaccaaauuucccaacugaagguuugagccccagccaggucacuauguucccccacauaauaguagauguuaggcaauuggaaccuguguugauccccuuacccgauguuaggaauaauuucuaucauuauaaucaaucaaaugauucuaccaucaaauugauagcaauguuguauacaccacuuagggcuaauaaugccggggacgaugucuucacagucucuugucgaguacucacaagaccaucccccgauuuugauuucauauuuuuagugccacccacaguugaaucaagaacuaaaccauucucugucccaauuuuaacuguugaggagaugaccaauucaagguuccccauuccuuuggaaaaguuguucacgggucccaguagcacauuuguuguccaaccacaaaacggcaggugcacuacugauggcguacuccuagguacuacccaacuguccccuguuaacaucugcaccuucagaggggguaucacccguauuggacagagugaauccuacaaaaugaauuuggccucccaaaauuggaacaauuaugacccaacagaagagaucccagccccucuagggacuccagauuucaaggggaggauucgaggucugcucacccaaaccacaaagggagcaggcucgacccgcggccacaaagcuacagugcucacugggggcuccgacuuuacuccaaaacuagguacaguucgauuugacaccaaaucaaucgauuuugaaaauaaucaaaacacaaaguucaccccagucgguguuguccaggaugguaauaaucaugaugagcccacacaaugggugcucccaaauuauucaggcccagacacucauaaugugcaccuggcccccgcuguagcucccacuuucccgggcgagcagcuccucuuuuucagauccacuaugcccggaugcagcggguaccccaaaauggaauuggauugucuacucccccaggaaugggugcagcacuucuaccaggaggcagccccagcacaaacugauguggcucuguugagauuugugaauccagacacagguaggguuuuguuugaauguaagcuccauaaaucaggcuaugucacaguggcucacacuggcgaucaugauuuggucaucccccccaaugguuauuucagauuugauuccugggucaaccaguuuuacacacuugcccccaugggaaaugggacggggcguagacguuaa

SEQ ID NO: 8449 - RNA, 1608 nt, Artificial Sequence
  VP1__Norovirus_and/or_Norovirus-like__JN699045
augaugauggcgucuaaggacgccccaacauccccugauggcgccaguggcgccggccagcugguaccggaggcuaauacagcugagcaaauuucaauggacccuguugcgggugcuucaacagcggucgcaacagccggacaagucaauaugauugacccauggauuuuuaauaauuuuguccaggcaccccaaggagaauuuacuauuuccccuaauaauacccccggugauaucuuguuugaucuacaauuaggaccccaucuuaacccauuucuggcucaucuuucacagauguacaauggaugggucggcaauaugcguguacgcauauuguuggcaggcaaugcuuuuacagcugggaaaauaaucauuugcuguguucccccugguuuugaugcuagaauacucacaauugcucaggcaacucucuucccacaccugauugcugauguuaggacucuugagccuguggagcuuccucuggaggacgugcguaauguucucuuucacaauagcagccagccgcaaccaacaaugcgauugguggcuauguuguauaccccacuccgcacgggcgguggcucuggaggcacugaugccuuugugguggcggguaggguacuuacgugcccugccccugauuuuagcuuuuuguuucuuguccccccuucuguugagcaaaagaccaggguauucagugucccuaauguaccucugaaagaccuuucaaauucucgugucccugugccuauacaggguauguuuauguccccagaugucaaccagucaguccaguuccagaacgggcguugucagauugauggccagcuucagggcaccaccccugucucgcuuagccaacuuugcaagaucagggguaagacuucaagcaaugccagagugcucaaucugagugagguggaugguacaccuuucaucccucucgaaucgccagcaccaguugguuuucccgaucuaggaggcugugacuggcauguaaauuucacuuuccaggcucagaaucaggacccgucucaaagugugaccuuugcaacuaaugaugcuagcuuuguuccauacuuaggcagcaucuccccucacaacgggggggauuuucauucaggugacaucauagguagccuuggcuggauuuccgccccguccgacaguucccaacuuaaugucuggacaauaccgaaguacggcuccagccucccagauguuacccaccuugcaccugcuguguuccccccagguuuuggggagguuaucuuguacuuucauuccacuuuuccagguucuggccagccagggcaacuccaagucccaugccuauuaccccaggaguucaucacucacuucugcaaugaacaggcucccaucgcuggggaggcugcccuccuccauuauguggacccugauacagggcgaaacuugggggaguuuaaacuuuaccccgauggguucaugaccugugucccuaauaguguuaguaguggcccucaaacucuucccaucaauggagucuuugucuuuguuucaugggugucuagauuuuaucaacucaagccugugggaacggccucagcggcuagaaggcuuuaa

SEQ ID NO: 8450 - RNA, 1608 nt, Artificial Sequence
  VP1__Norovirus_and/or_Norovirus-like__EF547395
augaugauggcgucuaaggacgccccaacauccccugauggcgcuaguggcgccggccagcugguaccggaggcuaauacagcugagcaaauuucaauggacccuguugcgggugcuucaacagcagucgcaacggcuggacaaguuaauaugauugacccauggauuuuuaauaacuuuguccaggcaccccaaggagaauucacuauuuccccuaauaauacccccggugauauuuuguuugaucuacaauuaggaccccaccuuaacccauuuuuggcucaucuuucgcagauguacaauggauggguuggcaauaugcguguacgcauauugcuggcagggaaugcuuuuacagcuggaaagauaauuaucugcuguguucccccugguuuugaugcuagaauacucacaauugcucaggcaacucuuuucccacaccugauugcugauguuaggacucuugagcccguggaacucccucuggaggacgugcgcaacguucucuuucacaauagcagccagccgcaaccaacaaugcgauugguggccauguuguacaccccacuccgcacgggcggugguucuggaggcacugaugccuuugugguggcagguaggguacuuacgugcccugccccugacuuuagcuuuuuguuucuuguccccccuucugucgagcaaaagaccaggguauucagugucccuaauguaccucugaaagaccuuucaaauucucgugucccugugccuauacaggguauguuuauguccccagaugucaaccagucaguccaguuucagaaugggcgcugucagauugauggccagcuccagggcaccaccccuguuucgcucagccagcuuugcaagaucagggguaagaccucgagcaaugccagagugcucaaucucagugagguagaugguucaccuuucaucccccucgaaucgccagcaccaguuggcuuucccgaucugggaggcugcgacuggcaugugaauuuuacuuuccaggcucaggaccaagacccaucccaaagugugaccuuugcaaccaaugaugcuagcuuuguuccauaccuaggcaguaucucuccccacaacgggggagauuuucauucaggugacaucauagguagccuuggcuggauuucugccccauccgacaguucccaacucaaugucuggacaauaccgaaguacggcuccagccucccagauguaacccaccuugcaccugcuguguuucccccaggcuuuggggagguuaucuuguacuucuacuccacuuuuccaggcucuggccaaccagggcaacuccaagucccaugucuauuaccucaggaguuuaucacucacuuuugcaaugaacaggcccccauugcuggggaggcugcccuccuccauuauguggauccugauacagggcgaaacuugggggaguucaagcuuuaccccgauggauucaugacuugugucccuaauaguguuaguaguggcccucaaacucuccccaucaauggagucuuugucuuuguuucaugggugucuagauucuaucaacuuaagccugugggaacggccucaguggccagaaggcuuuaa

SEQ ID NO: 8451 - RNA, 1608 nt, Artificial Sequence
  VP1__Norovirus_and/or_Norovirus-like__AY502008
augaugauggcgucuaaggacgccccaacauccccugauggcgcuaguggcgccggccagcugguaccggaggcuaauacagcugagcaaauuucaauggacccuguugcgggugcuucaacagcagucgcaacggcuggacaaguuaauaugauugacccauggauuuuuaacaacuuuguccaggcaccccaaggagaauucacuauuuccccuaauaauacccccggugauaucuuguuugaucuacaguuagggccccaccuuaacccauuuuuggcucaucuuucgcagauguacaauggauggguuggcaauaugcguguacguauauugcuggcagggaaugcuuuuacagcuggaaagauaauuaucugcuguguucccccugguuuugaugcuagaauacucacaauugcucaggcaacucuuuucccacaccugaucgcugauguuaggacucuugagcccguggaacucccucuggaggacgugcgcaacguucucuuucacaauagcagccagccgcaaccaacaaugcgauugguggcuauguuguacaccccacuccgcacgggcgguggcucuggaggcacugaugccuuugugguggcagguaggguacuuacgugcccugccccugacuuuagcuuuuuguuucuugucccuccuucugucgagcaaaagaccaggguguucagugucccuaauguaccucugaaagaccuuucaaauucucgugucccugugccuauacaggguauguuuauguccccagaugucaaccagucaguccaguuucagaaugggcgcugucagauugauggccagcuccagggcaccaccccugucucgcucagccagcuuugcaagaucagggguaagaccucgagcaaugccagagugcucaaucucagugagguagaugguucaccuuucaucccccucgaaucgccagcaccaguuggcuuucccgaccugggaggcugcgacuggcaugugaauuuuacuuuccaagcucaggaucaggacccaucucaaagugugaccuuugcaaccaaugaugcuagcuuuguuccauaccuaggcaguaucucuccccacaacgggggagauuuucauucaggugacaucauagguagccuuggcuggauuucugccccguccgacaguucccaacucaaugucuggacaauaccgaaguacggcuccagccucccagauguaacccaccuugcaccugcuguguuucccccagguuuuggggaggucaucuuguacuucuacuccacuuuuccagguucuggccaaccaguacaacuccaagucccaugucuauuaccucaggaguuuaucacucacuuuugcaaugaacaggcccccauugcuggggaggcugcccuccuccauuauguggauccugauacagggcgaaacuugggggaguucaagcuuuaccccgauggauucaugaccugugucccuaauaguguuaguaguggcccucaaacucuccccaucaauggagucuuugucuuuguuucaugggugucuagauucuaucaacuuaagccugugggaacggccucaguggccagaaggcuuuaa

SEQ ID NO: 8452 - RNA, 1608 nt, Artificial Sequence
  VP1__Norovirus_and/or_Norovirus-like__AY502007
augaugauggcgucuaaggacgccccaacauccccugauggcgccaguggcgcuggccagcugguaccggaggcuaacacagcugagcaaauuucaauggacccuguugcgggugcuucaacagcagucgcaacagcugggcaaguuaauaugauugacccauggauuuucaauaacuuuguccaggcgccccaaggagaauuuacuaucuccccuaauaauacccccggugacauuuuguuugacuuacaauuaggaccccaccuuaauccauuucuagcccaccucucacaaauguauaaugguugggucggcaauaugcguguacguauauugcuggcagggaaugcuuucacagcuggcaagauaaucauuugcuguguccccccugguuuugaugcuagaauacuuacaauagcccaagcaacucucuuuccacacuugauugcugauguuaggacucuugagccuguggagcucccucuggaggacgugcgcaacguucucuaucacaacaguagccagccgcagccaacaaugcgguugguggcuauguuguacacuccccuccgcacuggugguggcuccggagguacugaugccuuugugguugcgggcagggugcucacgugccccgccccugauuuuagcuuucuguuucuugucccccccuccguugagcagaagacuaggguuuuuaguguccccaacauaccccuaaaagaccuuucaaauucucguguuccugugccuauacagggcauguucauguccccagaugucaaucagucaguccaguuucagaacgggcgcugccaaaucgauggucaacuccaaggcacuaccccuguuucgcucagucaacuuugcaagauuagggguaagacuucaagcaaugccagaguacucaacuuaagugagguggauggcacacccuuuguuccucuugagucuccagcaccaguugguuuucccgacuuaggagguugugacuggcauguaaacuucacuuuccaggcucagaaucaggacccaucucaaagugugaccuuugcaacuaaugaugcuagcuuuguucccuacuuaggcagcaucucuccucacaaugggggggauuuucaugcaggugacaucauaggcagucuuggcuggauuucagccccgucugauaauacacaacuuaaugucuggacaauaccaaaguauggguccagucucccagaugucacucaccuugcaccugcuguguuccccccaggcuuuggggaggugauucuguacuucuacucuacauucccagguucuggacaaccuagucagcuucaagucccaugccuguugccucaggaguucaucacccacuucugcaaugaacaggcucccaucgcuggggaagcugcucuccuccauuacguggacccugacacggggcggaaccugggggaauucaagcucuauccugauggguuuaugaccuguguccccaauaguguuagcagugguccucaaacccuuccuaucaauggagucuuugucuuuguuucauggguauccagauuuuaucaacucaagccugugggaacggccucagcggcuagaaggcuuuaa

SEQ ID NO: 8453 - RNA, 1608 nt, Artificial Sequence
  VP1__Norovirus_and/or_Norovirus-like__KC998959
augaugauggcgucuaaggacgccccaacauccccugauggcgccaguggcgccggccagcugguaccggaggcuaauacagcugagcaaauuucaauggacccuguugcgggugcuucaacagcagucgcgacggcuggacaaguuaauaugauugacccauggauuuuuaauaauuuuguccaggcuccccaaggagaauucacuauuuccccuaauaauacccccggugauauuuuauuugauuuacaacuaggaccccaccuuaauccauuucuagcccaccucucacagauguauaaugguugggucggcaauaugcgugugcgcauacuguuggccgggaaugccuuuacagcuggaaagauaaucauuugcuguguccccccugguuuugaugcuagaauacucacaauagcucaagcaacucucuucccacauuuaauugcugauguuaggacucuugagccuguggagcuucccuuggaggaugugcgcaacguucucuaccauaacaguagccaaccgcagccaacaaugcggcugguugcuauguuguacaccccccuccgcacugguggugguuccggaggcacugaugccuuugugguggcgggcagggugcuuacgugccccgcccccgacuuuagcuuucuguuucuuguuccuccuuccguugaacaaaagaccaggguuuuuaguguccccaauauaccccugaaagaccucucaaauucucguguccccgugccuguacagggcauguuuauguccccagaugucaaucagucaguccaguuucagaaugggcgcugccaaauugauggucaacuccagggcaccacuccugucucacucagccaacucugcaagauuagggguaaaacuucuagcaaugcuagggugcucaacuuaagugagguagauggcacacccuuuaucccucuugaaucaccagcgccaguuggcuuucccgacuuaggagguugugacuggcauguaaauuucacuuuccaggcucaagaucaggacccaucucaaagugugaccuuugcaacuaaugaugccagcuuuguccccuaccuagguaguaucuccccucacaaugggggagacuuucaugcaggcgacaucauagguagccuugguuggauuucagccccaucugguaauucacagcuuaauguuugggcaauaccaaaguauggaucuagucucccagaugucacucaccuugccccugcuguguuccccccagguuuuggggaggugauucuauacuucuacucuaccuucccagguucuggacaacccagccaacuucaagucccauguuuguugccucaggaguuuaucacccacuucuguaacgaacaggcucccaucgcuggggaggcugcccuccuucacuacguggacccugauacggggcgaaacuugggggaauucaaacuuuacccugauggguuuaugaccugugucccuaauaguguuaguaguggcccucaaacccuuccuaucaauggagucuuugucuuuguuucauggguaucuagauucuaucaacucaagccugugggaacggccucagcggcuagaaggcuuuaa

SEQ ID NO: 8454 - RNA, 1608 nt, Artificial Sequence
  VP1__Norovirus_and/or_Norovirus-like__GQ856464
augaugauggcgucuaaggacgccccaacauccccugauggcgcuaguggcgccggccagcugguaccggaggcuaauacagcugagcaaauuucaauggacccuguugcgggugcuucaacagcagucgcaacggccgggcaaguuaacaugauugacccauggaucuucaacaacuuuguccaagcaccccaaggagaauucacuauuuccccuaauaauacccccggugacauuuuguuugaccuacaacuaggaccccaucuuaacccauuucuagcccaucucucacagauguauaaugguugggucggcaauaugcgugugcgcauauuguuggccgggaacgccuucacagcuggaaagauaaucauuugcuguguccccccugguuuugaugcuagaauacucacaauagcucaagcaacucucuucccacauuugauugcugauguuaggacucuugagccuguggagcuuccuuuggaggacguacgcaacguucucuaccacaacaguagccagccacagccaacaaugcggcugguugcuauguuguacaccccccuccgcacugguggugguucuggaggcacugaugccuuugugguggcgggcagggugcuuacgugccccgcccccgacuuuagcuuuuuguuucuuguucccccuuccguugaacaaaagaccagaguuuucaguguccccaauauaccucugaaagaccucucaaacucucgugucccugugccuauacagggcauguuuauguccccagauguuaaucagucaguccaguuucaaaacggacgcugccaaauugauggucaacuccagggcaccaccccagucucgcucagccaacucugcaagauuagggguaaaacuucaagcaaugcuagggugcucaacuuaagugagguagaugguacaccuuucaucccucuugaaucaccagcgccaguagguuuuccugacuuaggaggcugugacuggcacguaaauuucacuuuccagacucaagaucgggacccaucucaaagugugaccuuugcaaccaaugaugccagcuuuguccccuacuuagguagugucuccccucacaauggggaagguuuucaagcaggcgacaucauagguagccuuggguggauuucagccccgucugauaauucacaauuuaauguuugggcaauaccaaaguauggaucuagucucccagaugucacccaucuugcuccugcuguguuccccccaggcuuuggggaggugauccuauauuucuacucuaccuucccagguucuggacaacccagucaacuucaagucccauguuuguugccucaggaguucaucacccauuucuguaacgaacaggcucccaucgcuggggaggcugcccuccuccacuacguggacccugacacggggcggaacuugggggaauucaaacucuauccugauggguuuaugaccugugucccuaauaguguuagcaguggcccucaaacccuuccuauuaauggagucuuugucuuuguuucauggguguccagauucuaucaacucaagccugugggaacggccucagcggcuagaaggcuuuaa

SEQ ID NO: 8455 - RNA, 1608 nt, Artificial Sequence
  VP1__Norovirus_and/or_Norovirus-like__GQ856463
augaugauggcgucuaaggacgccccaacauccccugauggcgcuaguggcgccggccagcugguaccggaggcuaauacagcugagcaaauuucaauggaccccguugcgggugcuucaacagcagucgcaacggcugggcaaguuaacaugguugacccauggaucuucaacaacuuuguccaagcaccccaaggagaauucacuauuuccccuaauaauacccccggugauauuuuguuugaccuacaacuaggaccccaucuuaacccauuucuagcccaucucucacagauguauaaugguugggucggcaauaugcgugugcgcauauuguuggccgggaacgccuucacagcuggaaagauaaucauuuguuguguccccccugguuuugaugcuagaauacucacaauagcucaagcaacucucuucccacauuugauugcugauguuaggacccuugagccuguggagcuuccuuuggaggacguacgcaacguucucuaccacaacaguagccagccgcagccaacaaugcggcugguugcuauguuguacaccccccuccgcacugguggugguucuggaggcacugaugccuuugugguggcggguagggugcuuacgugccccgcccccgacuuuagcuuuuuguuucuuguucccccuuccguugaacaaaagaccagaguuuucaguguccccaauauaccucugaaagaccucucaaauucucgugucccugugcccauacagggcauguuuauguccccagauguuaaucagucaguccaguuucaaaacggacgcugccaaauugauggucaacuccagggcaccaccccagucucgcucagccaacucugcaagauuagggguaaaacuucaagcaaugcuagggugcucaacuuaagugagguagaugguacacccuucaucccucuugaaucaccagcgccaguagguuuucccgacuuaggaggcugugacuggcacguaaauuucacuuuccagacucaagaucgggacccaucucaaagugugaccuuugcaaccaaugaugccagcuuuguccccuacuuagguagugucuccccucacaauggggaagguuuucaagcaggcgacaucauagguagccuuggguggauuucagccccgucugauaauucacaauucaauguuugggcaauaccaaaguauggaucuagucucccagacgucacccaucuugcuccugcuguguuccccccaggcuuuggggaggugauccuauauuucuacucuaccuucccagguucuggacaacccagucaacuucaagucccauguuuguugccucaggaguucaucacccacuucuguaacgaacaggcucccaucgcuggggaggcugcccuccuccacuacguggacccugacacggggcggaacuugggggaauucaaacuuuauccugauggguuuaugaccugugucccuaauaguguuagcaguggcccccagacccuuccuauuaauggagucuuugucuuuguuucauggguguccagauucuaucaacucaagccugugggaacggccucagcggcuagaaggcuuuaa

SEQ ID NO: 8456 - RNA, 1608 nt, Artificial Sequence
  VP1__Norovirus_and/or_Norovirus-like__KM036372
augaugauggcgucuaaggacgccccaacauccccugauggcgcuaguggcgccggccagcugguaccggaggcuaauacagcugagcaaauuucaauggacccuguugcgggugcuucaacagcagucgcaacggcugggcaaguuaacaugauugacccauggaucuucaacaacuuuguccaagcaccccaaggagaauucacuauuuccccuaauaauacccccggugauauuuuguuugaccuacaauuaggaccccaucuuaacccauuccuagcccaucucucacagauguauaaugguugggucggcaauaugcgugugcgcauauuguuggccgggaacgccuucacagcuggaaagauaaucauuugcuguguccccccugguuuugaugcuagaauacucacaauagcucaagcaacucucuucccacauuugauugcugauguuaggacccuugagccuguagagcuucccuuggaggacguacgcaacguucucuaccacaacaguagccagccacagccaacaaugcggcugguugcuauguuguacaccccccuccgcacugguggugguucuggaggcacugaugccuuugugguggcgggcagggugcuuacgugccccgcccccgacuuuagcuuuuuguuucuuguucccccuuccguugaacaaaagaccagaguuuucaguguccccaacauaccucugaaagaccucucaaauucucgugucccugugccuguacagggcauguuuguguccccggauguuaaucagucaguucaguuucaaaacggacgcugccaaauugauggucaacuccagggcaccaccccagucucgcucagccaacucugcaagauuagggguaaaacuucaagcaaugcuagggugcucaacuuaagugagguagaugguacaccuuucaucccucuugaaucaccagcgccaguagguuuuccugacuuaggaggcugugacuggcacguaaauuuuacuuuccagacucaagaucgggacccaucucaaagugugaccuuugcaaccaaugaugccagcuuuguccccuacuuaggcagugucuccccucacaauggggaagguuuucaagcaggugacaucauagguagccuuggguggauuucagccccgucugauaauucacaauuuaauguuugggcaauaccaaaguauggaucuagucucccagaugucacccaucuugcuccugcuguguuccccccaggcuuuggggaggugauccuauauuucuacucuaccuucccagguucuggacaacccagucaacuucaagucccauguuuguugccucaggaguucaucacccauuucuguaacgaacaggcucccaucgcuggggaggcugcccuccuccacuacguggacccugacacggggcggaacuugggggaauucaaacucuauccugauggguuuaugaccuguguccccaauaguguuagcaguggcccucaaacccuuccuauuaauggagucuuugucuuuguuucauggguguccagauucuaucaacucaagccugugggaacggccucagcggcuagaaggcuuuaa

SEQ ID NO: 8457 - RNA, 1608 nt, Artificial Sequence
  VP1__Norovirus_and/or_Norovirus-like__AF538678
augaagauggcgucuaaggacgccccaccaucgccugauggcgccaguggcgcuggccagcuagugccggagguuaauacagcugaccaaauuucaauggauccuguugcgggugcuucuaccgcaguugcaacagcugggcaaguuaauaugauugauccauggauauucaacaauuuuguccaggccccucagggugaauuuaccaucucuccaaauaauacccccggugauauuuuauuugauuuacaauugggcccccaucugaauccuuucuuagcucauuuaucacagauguauaauggguggguuggcaauaugcggguccgcauauugcuggcaggcaaugcuuucacagcugguaagauaaucauauguuguguccccccuggcuuugaugcuagaauacuuacuauugcucaagcuacccuauuuccucacuugauugcugauguuaggacucuugagccaguagaguuaccucuugaggauguccgcaauguccucuaccacaauagcagccagccacaaccaaccaugcgacugguggccaugcuauacaccccauugcgcacaggcggugggucuggaggcacugaugcuuuugugguugcugggagaguucugacaugccccgcaccagauuuuaguuuucuauuucuuguuccucccucuguugagcaaaagacuagggucuuuagugugcccaacauaccacuuaaagaucucucaaauucccgagugccaaccuugauucagggcauguuuguuucuccugaugucaaucaaucagugcaguuucaaaacgggcgaugccaaauugauggucagcuacaggguaccaccccagugucccucagccaauuaugcaagaucagagguaagacuuccaguaauaccagagugcuuaaccuuagugagguugaugggacaccuuuuguaccacuugaguccccugcaccuguagguuucccagacauaggcgggugugauuggcauguugguuucacuuuugaggcacgagaucaggaccccucccagaaugugaccuuugcaacuaaugauucuagcuuugugccauaccuuggcaguaucucaccccauaauggugauggguuucauaguggugacauuguaggcagccuggauuggaucucagcuccaucggauggcuccgcacuugauguguggucuauaccaaaguaugggucaucccucccagaugucacccaccuagccccuguagucuuucccccugguuuuggugaggucauccucuacuuucauucuaaauuuccugguucuggccccacugauaaacuuaggguuccaugucugaugccacaagaguucauaacacauuucuguaaugagcaagcacccauagcgggggaggcugcccuccuucacuauguggacccugacacagguagaaacuuaggggaguucaaacuuuauucagauggcuuuaugacaugcgugccuaacaguaucagcagugguccccagacucugccaaucaaugguguguuuguauuuguguccuggguguccagauucuaccaacuuaagccugugggaacggccucagcggccaggaggcuuuaa

SEQ ID NO: 8458 - RNA, 1608 nt, Artificial Sequence
  VP1__Norovirus_and/or_Norovirus-like__KC294198
augaugauggcgucuaaggacgccccaacauccccugauggcgccaguggcgccggccagcugguaccggaggcuaauacagcugagcaaauuucaauggacccuguugcgggugcuucaacagcagucgcgacggcugggcaaguuaauaugauugacccauggauuuuuaauaacuuuguccaggcaccucaaggagaauucacuauuuccccuaauaauacccccggugacauuuuguuugauuuacaacuaggaccccaccuuaauccauuucuagcccaucucucacagauguacaaugguugggucggcaauaugcgugugcgcauacuguuggccgggaaugccuuuacagcuggaaagauaaucauuugcuguguccccccugguuuugaugcuagaauacucacaauagcucaagcaacucuuuucccacacuuaauugcugauguaaggacccuugagccuguggagcuuccuuuggaggaugugcgcaauguucucuuccacaacaguagccaaccgcagccaacaaugcggcugguagcuauguuguacacuccccuccgcacugguggugguuccggaggcacugaugccuuugugguggcggguagggugcuuacgugccccgcccccgacuuuaguuuucuguuucuuguccccccuuccguugaacaaaagaccagaguuuucaguguccccaauauaccccugaaggaucucucaaauucccgugucccugugccuguacagggcauguuuauguccccagauguuaaucagucaguccaguuucagaauggacgcugccaaauugauggccaacuccaaggcacuacuccagucucgcucagccaacucugcaagauuagggguaaaacuucuaguaaugcuagggugcucaacuuaagugagguagauggcacacccuucaucccacuugaaucaccagcgccaguugguuuucccgacuugggagguugugacuggcauguaaauuucacuuuccaggcucaaaaucaggacccaucucaaaguguaaccuuugcaacuaaugaugccagcuuuguccccuaucuagguaguaucucuccucacaaugggggagauuuucaugcaggcgacaucauagguagccuugguuggauuucagccccgucugauaauucacaacuuaauguuuggacaauaccaaaguauggaucuagucucccagaugucacucaucuugccccugcuguguuccccccaggcuuuggggaggugaucuuguacuucuacucuaccuucccggguucuggacaauccagccaacuucaagucccauguuuguugccucaggaguucaucacccacuucuguaacgaacaggcucccaucgcuggggaggccgcccuccuccacuacguggacccugauacggggcgaaacuugggggaauuuaaacuuuacccugauggguuuaugaccuguguccccaauaguguuaguaguggcccucaaacccuuccuaucaauggagucuuugucuuuguuucauggguaucuagauucuaucaacucaagccugugggaacggccucagcggcuagaaggcuuuaa

SEQ ID NO: 8459 - RNA, 1608 nt, Artificial Sequence
  VP1__Norovirus_and/or_Norovirus-like__KT732280
augaugauggcgucuaaggacgccccaacaucgccugauggcgccaguggcgcuggccagcuagugccggagguuaauacagcugaccaaauuucaauggauccuguugcgggugcuuccacugcaguugcaacugcuggacaaguuaauaugauugauccauggauauucaauaauuuuguccaggccccucagggugaauuuacuauuuccccaaauaauacccccggugauauuuuguuugauuugcaauugggcccccauuugaaucccuucuuagcucauuuaucacagauguauaaugggugggucggcaauaugcggguccgcauauugcuggcaggcaaugcuuuuacagcugguaagauaaucauauguuguguccccccugguuuugaugcuagaauacuuacuauugcucaagcuacucuauuuccucauaugauugcugauguuaggacucuugaaccgguagaguuaccucucgaggacgugcguaauguccucuaccacaacagcagccagccacagccaaccaugcgucugguggcuaugcuauacaccccacugcgcacaggcggugggucuggaggcacugaugcuuuugugguugcugggagagugcugacauguccugcaccagacuucaguuuucuauuccuuguuccucccucuguagagcaaaagacuagggucuucagugugcccaauauaccacucaaggaucucucaaacucucgagugccaaccuugauacaagguauguuuguuucuccugauguuaaucaaucagugcaauuccaaaaugggcggugccaaauugauggccaguuacaagguacuaccccagugucccucagccaauuauguaagaucagagguaagacuuccagcaaugccagaguacucaaccuuagugagguugauggaacaccuuuugugccccuugaguccccugcaccuguagguuucccagauuuaggcgggugugauuggcaugucggcuuuacuuuugaggcacgagaccaggacccuucccagaaugugaccuuugcaacuaaugauucuagcuuugugccauaucuuggcaguaucucaccccauaauggugauggguuucauaguggugauauuauagguaguuuagauuggauuucagcuccaucggaugguuccacacuugacgugugguccauaccaaaauauggaucaucucucccagaugucacucaucuggccccugcaguuuuucccccugguuuuggugaggucauccucuacuuucacuccaaauuuccugguucuggcccuacugauaaacucagggucccaugucugauaccacaagaguucauaacacacuucugcaaugagcaagcaccuauagcgggagaggcugcccuccuucacuauguggacccugacacagguaggaacuugggggaauucaagcuuuauccagauggcuuuaugacaugugugccuaacagcaucagcaguggcccccagacucugccaacuaacgguguguuuguguuuguguccugggugucuagauuuuaccaacuuaagccugugggaacggccucaauggccaggaggcuuuaa

SEQ ID NO: 8460 - RNA, 1608 nt, Artificial Sequence
  VP1__Norovirus_and/or_Norovirus-like__LC101822
augaugauggcgucuaaggacgucccaacaucgccugauggcgccaguggcgcuggccagcuagugccggagguuaauacagcugaccaaauuucaauggacccuguugcaggugcuuccacugcaguugcaacagcugggcaaguuaauaugauugauccauggauauucaauaauuuuguccaggccccccagggugaauuuacuauuuccccaaauaauacccccggugacauuuuguuugauuuacaauuaggcccccaucugaaucccuucuuagcucauuuaucacagauguauaauggauggguuggcaacaugcggguucgcauauugcuggcaggcaaugcuuucacagcugguaagauaaucauauguuguguuccccccggcuuugaugcuagaauacuuacuauugcucaagcuacucuauucccucacuugauugcugauguuagaacucuugaaccaguagaauuaccucucgaggaugugcgcaacguccucuaccacaacagcagccagccacaaccaaccaugcggcugguagcuaugcuauacaccccacugcguacaggcggugggucuggaggcacugaugcuuuugugguugcugggagagugcugacauguccugcaccagauuuuaguuuucuguuucuuguuccucccucuguagagcaaaagacuaggguuuucaguguacccaauauaccacucaaggaucucucaaacuccagagugccaaccuugauucaaggcauguuuguuucuccugauguuaaucaaucagugcaauuccaaaaugggcggugccaaauugauggccagcugcaaggcaccaccccagugucccucagccaauuauguaagaucagagguaagacuuccaguaauaccagaguacuuaaucuuagugagguugaugggacaccuuuugugccccuugaguccccugcaccuguagguuucccagauauaggcgggugugauuggcaugucggcuucacuuuugaggcacgagaccagggccccucccagaaugugaccuuugcaacuaaugauucuagcuuugugccauaucuuggcaguauuucaccccauaauggugauggguuccauaguggugauauuauagguaguuuagauuggaucucagcuccaucggaugguucugcacuugaugugugguccauaccaaaauauggaucaucucucccagauguuacccaucuagcuccugcagucuuucccccuggcuuuggugagguuauccucuacuuccauucuaaauuuccugguucugguccuacugauaaacuuagggucccaugucugaugccacaagaguucauaacacacuuuugugaugagcaagcacccauagcgggggaggcugcccuccuucacuauguggauccugacgcaggcaggaacuuaggggaguuuaagcuuuauccagauggcuuuaugacgugugugcccaacagcaucagcaguggcccccagacucugccaaucaaugguguguuuguauuuguguccuggguauccagauuuuaccaacuuaagccugugggaacggccucuauggccaggaggcuuuaa

SEQ ID NO: 8461 - RNA, 1608 nt, Artificial Sequence
  VP1__Norovirus_and/or_Norovirus-like__KP407451
augaugauggcgucuaaggacgcuccaacauccccugauggcgcuaguggcgccggccagcugguaccggaggcuaauacagcugagcaaaucucaauggacccuguugcgggugcuucaacagcagucgcaacggcugggcaaguuaacaugauugacccauggaucuucaauaacuuuguccaagcgccccaaggagaauucacuauuuccccuaauaauacccccggugauauuuuguuugaucuacaacuaggaccccaucuuaacccauuucuagcccaucucucacagauguauaaugguugggucggcaauaugcgugugcgcauauuguuggccggcaacgccuucacagcuggaaagauaaucauuugcuguguccccccuggcuuugaugcuagaauacucacaauagcucaagcaacucucuucccacauuugauugcugacguuaggacccuugagccuguggagcuuccuuuggaggacguacgcaacguucucuaccacaacaguagccagccgcagccaacaaugcggcugguugcuauguuguauaccccccuccgcacugguggugguucuggaggcacugaugccuuugugguggcgggcagggugcuuacgugccccgccccugacuuuagcuuuuuguuucuuguucccccuuccguugaacaaaagaccagaguuuuuaguguccccaauauaccucugaaagaucucucaaauucucgugucccugugccuauacagggcauguuuauguccccagauguuaaucagucaguccaguuucaaaacgggcgcugccaaauugauggucaacuccagggcaccaccccagucucgcucagccaacucugcaagauuagggguaaaacuucaagcaaugccagggugcucaacuugagugagguagaugguacacccuucaucccccuugaaucaccagcgccaguagguuuucccgacuuaggaggcugugacuggcacguaaauuucucuuuccagacucaagaucgggacccaucucaaagugugaccuuugcaaccaaugaugccagcuuuguucccuaccuagguagugucuccccucacaauggggaagguuuucaagcaggcgacaucauagguagccuuggguggauuucagccccgucugauaauucacaauuuaauguuugggcaauaccaaaguauggaucuagucucccagaugucacccaucuugcuccugcuguguuccccccaggcuuuggggaggugauccuauauuucuacuccaccuucccagguucuggacaacccagucaacuucaagucccauguuuguuaccucaggaguucaucacccacuucugcaacgaacaggcucccaucgcuggggaggcugcccuccuccacuacguggacccugacacggggcgaaacuugggggaauucaaacuuuauccugauggauuuaugaccugugucccuaauaguguuagcaguggcccucaaacccuucccauuaauggagucuuugucuuuguuucauggguauccagauucuaucaacucaagccugugggaacggccucagcggcuagaaggcuuuaa

SEQ ID NO: 8462 - RNA, 1608 nt, Artificial Sequence
  VP1__Norovirus_and/or_Norovirus-like__LN854564
augaugauggcgucuaaggacgccccaacauccccugauggcgccaguggcgccggccagcugguaccggaggcuaauacagcugagcaaauuucaauggacccuguugcgggugcuucaacagcagucgcgacggcugggcaagugaauaugauugacccauggauuuuuaauaacuuuguccaggcaccucaaggagaauucacuauuuccccuaauaauacccccggugauauuuuguuugauuuacaauugggaccccaccuuaauccauuuuuagcccaucucucacagauguauaaugguugggucggcaauaugcgugugcgcauacuguuggccgggaaugccuuuacagcuggaaagauaaucauuugcuguguccccccuggcuuugaugcuagaauacuuacaauagcucaagcaacccucuucccacacuuaauugcugauguuaggacccuugagccuguggagcuuccuuuggaggaugugcgcaacguucucuaccacaauaguagucagccgcagccaacaaugcggcugguugcuauguuguacacuccccuccgcacugguggugguuccggaggcacugaugccuuugugguggcggguagggugcuuacgugccccgcccccgauuuuaguuuccuguuucuuguuccucccuccguugaacaaaagacuagaguuuucaguguccccaauauaccccugaaagaucucucaaauucucguguccccguacccauacagggcauguuuauguccccagauguuaaucagucaguccaguuucagaaugggcgcugccagauugauggucaacuccagggcaccaccccagucucgcucagccaacucugcaagauuagggguaaaacuucuaguaaugccagggugcucaacuuaagcgagguagauggcacaccuuuuaucccccuugaaucaccagcgccaguugguuuucccgacuuaggagguugugacuggcaugugaauuucacuuuccaggcucaaaaccaggacccaucccaaagugugaccuuugcaacuaaugaugccagcuuugucccuuaccuagguagcauuuccccucauaaugggggagacuuucaugcaggcgacaucauagguagccuuggauggauuucagccccgucugacaauucacaacuuaauguuuggacaauaccaaaguacggaucuagucucccagaugucacucaucuugcuccugcuguguuccccccaggcuuuggggaagugauccuauacuucuauucuaccuucccagguucuggacaaccuagucaacuucaagucccauguuuguugccccaggaguucaucacccacuucuguaaugaacaagcucccaucgcuggggaggcugcucuccuccacuacguggacccugauacgggccggaacuugggggaguucaaacuuuacccugauggauuuaugaccugugucccuaauaguguuagcaguggcccucaaacccuaccuaucaauggagucuuugucuuuguuucauggguguccagauucuaucaacucaagccugugggaacggccucagcggcuagaaggcuuuaa

SEQ ID NO: 8463 - RNA, 1608 nt, Artificial Sequence
  VP1__Norovirus_and/or_Norovirus-like__JQ388274
augaugauggcgucuaaggacgccccaacauccccugauggcgccaguggcgccggccagcugguaccggaggcuaauacagcugagcaaauuucaauggacccuguugcgggugcuucaacagcagucgcgacggcuggacaaguaaauaugauugacccuuggauuuuuaauaauuuuguccaggcaccucaaggagaauucacuauuuccccuaauaauacccccggugauauuuuguuugauuuacaauugggaccccaccuuaacccauuucuagcccaucucucacagauguauaaugguugggucggcaauaugcgugugcgcauacuguuggccgggaaugccuuuacagcuggaaagauaaucauuugcuguguccccccugguuuugaugcuagaauacucacuauagcucaagcaacccucuucccacacuuaauugcugauguaaggacccuugagccuguggagcuuccuuuggaggaugugcgcaacguucucuaccacaauaguagccagccgcagccaacaaugcggcugguugcuauguuguacacuccccuccgcacugguggugguuccggaggcacugaugccuuugugguggcggguagggugcuuacgugccccgcccccgauuuuaguuuucuguuucuuguucccccuuccguugaacagaagacuagaguuuucaguguccccaauauaccccuuaaagaucucucaaauucucgugucccugugcccguacagggcauguuuauguccccagauguuaaucagucaguccaguuucagaaugggcguugccaaauugauggucaacuccagggcaccaccccagucucgcucagccaacucugcaagauuagggguaaaacuucuagcaaugcuagggugcucaacuuaagugagguggauggcacaccuuuuaucccccuugagucaccagcgccagucgguuuucccgacuugggagguugugacuggcauguaaauuucacuuuccaggcccaaaaucaggacccaucccaaagugugaccuuugcaacuaaugaugcuagcuuugucccuuaccuagguagcauuuccccucacaaugggggggauuuucaugcaggugacaucauagguagccuuggauggauuucagcuccgucugacaacucacaacuuaauguuuggacaauaccaaaguauggaucuagucucccagaugucacccaccuugcuccugcuguguuccccccaggcuuuggggaagugauccuauacuucuauucuaccuucccagguucugggcaaccuagucaacuucaagucccauguuuguuaccccaggaguucaucacucacuucuguaaugaacaagcucccauugcuggggaggcugcccuccuccacuacguggacccugauacgggccggaacuugggggaguucaaacuuuacccugauggauuuaugaccugugucccuaauaguguuaguaguggcccucaaacccuaccuaucaauggagucuuugucuuuguuucauggguguccagauucuaucaacucaagccugugggaacggccucagcggcuagaaggcuuuaa

SEQ ID NO: 8464 - RNA, 1608 nt, Artificial Sequence
  VP1__Norovirus_and/or_Norovirus-like__KP027330
augaugauggcgucuaaggacgccccaacaucgccugauggcgccaguggcgcuggccagcuagugccggagguuaauacagcugaccaaauuucaauggauccuguugcgggugcuuccacugcaguugcaaccgcugggcaaguuaauaugauugauccauggauauucaauaauuuuguccaggccccucagggugaauuuacuauuuccccaaacaauacccccggugauauuuuguuugauuuacaauugggcccccauuugaaccccuucuuagcucauuuaucacagauguauaaugggugggucggcaauaugcggguccgcauauugcuggcaggcaaugcuuuuacagcugguaagauaaucauauguugugucccccccgguuuugaugcuagaauacuuacuauugcucaagcuacucuauuuccucauaugauugcugauguuaggacucuugaaccgguagaguuaccucucgaggacgugcgaaauguccucuaccauaacagcagccagccacagccaaccaugcgucugguggcuaugcuauacaccccacugcgcacaggcggugggucuggaggcacugaugcuuuugugguugcugggagagugcugacauguccugcgccagacuucaguuuucuauuucuuguuccucccucuguagagcaaaagacuagggucuucagugugcccaauauaccacucaaggaucucucaaacucucgagugccaaccuugauacaagguauguuuguuucuccugauguuaaucaaucagugcaauuccaaaaugggcggugccaaauugauggccaguuacaagguaccaccccagugucccucagccaauuauguaagaucagagguaagacuuccagcaaugccagaguacucaaccuuagugagguugaugggacaccuuuugugccccuugaguccccugcaccuguagguuucccagauuuaggcgggugugauuggcaugucggcuuuacuuuugaggcacgagaccaggacccuucccagaaugugaccuuugcaacuaaugauucuagcuuugugccauaucuuggcaguaucucaccccauaauggugauggguuucauaguggugauauuauagguaguuuagauuggauuucagcuccaucggaugguuccacacuugacgugugguccauaccaaaauaugggucaucucucccagaugucacucaucuggccccugcaguuuuucccccugguuuuggugaggucauccucuacuuucacuccaaauuuccugguucuggcccuacugauaaacucagggucccaugucugauaccacaagaguucauaacacacuucugcaaugagcaagcacccauagcgggggaggcugcccuccuucacuauguggacccugacacagguaggaacuugggggaauucaagcuuuauccagauggcuauaugacaugugugccuaacagcaucagcaguggcccccagacucugccaacuaacgguguguuuguguuuguguccuggguguccagauuuuaccaacuuaagccugugggaacggccucaauggccaggaggcuuuaa

SEQ ID NO: 8465 - RNA, 1608 nt, Artificial Sequence
  VP1__Norovirus_and/or_Norovirus-like__AF093797
augaugauggcgucuaaggacgccccaccaucgccugauggcgccaguggcgcuggccagcuagugccggagguuaauacagcugaccaaauuucaauggauccuguugcgggugcuucuaccgcaguugcaacagcugggcaaguuaauaugauugauccauggauauucaacaauuuuguccaggccccccagggugaauuuaccauuucuccaaauaauacccccggugauauuuuauuugauuuacaauugggcccccacuugaauccuuucuuagcucauuuaucacagauguacaauggauggguuggcaauaugcggguccgcauauugcuggcaggcaaugccuucacagcugguaagguaaucauauguuguguccccccuggcuuugaugcuagaauacuuacuauugcucaagcuacccuauuuccucacuugauugcugauguuaggacucuugaaccaguagaauuaccucucgaggauguacgcaauguccucuaccacaauagcagccagccacagccaaccaugcgacugguggcuaugcuauauaccccauugcgcacaggcggugggucuggaggcacugaugcuuuugugguugcugggagaguucugacaugccccgcaccagacuuuaguuuucuguuccuuguuccucccucuguagagcaaaagacuagggucuuuaguguccccaauauaccacucaaagaucucucaaauucccgagugccaaccuugauccagggcauguuuguuucuccugaugucaaucaaucggugcaguuccaaaaugggcgaugucaaauugauggucaguugcaagguaccaccccaguaucccucagccaauuauguaagaucagagguaggacuuccaguaauaccagagugcuuaaccuuagugagguugacgggacaccuuuuguaccacuugaguccccugcaccuguagguuuuccagacauaggcgggugugauuggcauguugguuucacuuuugaggcacgagaccaggaccccucucagaaugugaccuuugcaaccaaugauucuagcuuuguaccauaucuuggcaguauuucaccccacaauggugauggguuccauaguggugacaucauagguaguuuggauuggaucucagcuccaucggauggcuccgcacuugauguauggucuauaccaaaguauggaucaucucuuccagaugucacccaucuggccccugcaguuuuucccccuggcuuuggugagguuauccuuuacuuucacucuaaauuuccugguucuggccccacugauaaacuuaggguuccauguuugauaccacaagaguuuauaacacauuucuguaaugagcaagcacccauagcgggggaggcugcccuccuucacuauguggacccugacacagguaggaacuuaggggaauucaagcuuuauccagauggcuuuaugacaugugugccuaacagcaucagcagugguccccagacucugccaaucaaugguguguuuguauuuguguccuggguauccagauuuuaccaacuuaagccugugggaacggccucagcggccaggaggcuuuaa

SEQ ID NO: 8466 - RNA, 1608 nt, Artificial Sequence
  VP1__Norovirus_and/or_Norovirus-like__AB810006
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcucccccauuugaucguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuaguuccucccucuguagaguccaaaacuaaaccauucacacuuccaauauugaccauuucugaacuaaccaacucccgguuccccaucccaauugagcaacuguacacggccccaaaugagaauaauguuguacagugucaaaauggaaggugcaccuuggauggagagcuucagggcaccacccagcuacuaucaagugcagucugcucuuacaggggcaggacuguggcuaacagaggggacaauugggaccagaauuugcuccagcugaccuacccaaguggugcaagcuaugaccccacugaugaagugccagcaccuuugggcacccaggauuucagugggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggaguugcucagaaugaaaacacccccuuccagcaauggguucuaccacacuacgcaggugcucucgcucuaaacaccaauuuggcacccgcuguugccccgacuuucccuggcgagcaauuacuguucuucaggucucguguuccauguguucaaggccugcgcgggcaggaugcuuucauagauugucuccuaccucaagagugggugaaucauuuuuaucaagaggcugcucccucccaagcagacguugcccucaucagguaugucaacccugauacuggucgcacgcuguuugaggccaaauugcauaggucagguuuuauuacuguaucacacacuggugccuacccucuugugguccccccaaaugguccuuucagguuugauucuuggguuaaucaauucuacucacucgcccccaugggaacuggcuaa

SEQ ID NO: 8467 - RNA, 1605 nt, Artificial Sequence
  VP1__Norovirus_and/or_Norovirus-like__LC101825
augaugauggcgucuaaggacgcuacaccaagcgcagauggcgcgaauggcgccggucagcucgugccggagguuaacaaugcugaaccacugccucuugacccuguggcuggggcuucuacugcucuagccacugcuggucaagucaauaugauugacccuuggauuuucaauaauuuuguccaagccccucagggugaauucacaaucuccccuaacaauacccccggugauauauuguuugauuugcaauuaggaccucaucuuaaucccuuccuugcccauuugucucaaauguauaaugguugggucgguaacaugcgagucagggucauccuggcgggcaacgcauuuacugccgguaaagugauaauuuguuguguccccccugguuuucaauccaggacccuaucaauugcucaggcuacucuuuucccucaugugauugcugauguucguacauuggaaccacuugaaaucccauuagaggaugucaggaacacauuguaucacaacaaugauagccagccgacaaugcgcuuauugugcaugcuguacacgccacuccguacugguggcgguucuggcggcacagacgcguuugucguugcagggagagucuuaaccuguccaaguccugacuucaauuuucucuuccuagucccaccgacuguggaacagaagacacguccuuuuagugugcccaauaucccacuucagaaucuuuccaauucucgaguuccuagucugauccaaagcaugguucucucuagugaccaugcgcaaacaguccaauuucagaaugguagguguacuacugacggucaucugcuagggaccaccccuguuucuucuggucaacucaugaaauuuaggggcaaagugacuccagguucgaaggugcugaaccuaacagaacuagaugguucaccauuccuggccuuugagcccccagccccugcuggauucccugaucuuggaaagugugauuggcauauugaaaugagucucuaucagguuaacaaucaagauaaccccauuguguugcgugcuauugaaccuaauucaucuucuuuuguaccgcaccuugguaguguuucuuuuaaucagaauguugaugcagcuggugauuauguuuguacuauacaguauacuucacccccuuccaauucucaugaugcugauguugauuucuggucuaucccugauuaugguucuaauuuggcugaggcaucgcagcuugcuccaguuguuuaccccccugguuuuggugaagcuauugucuauuucaugucacguguccccggcuggaauagaacuaauaggcucaaucuggucccuugccuauugccccaagaguucauugggcacuuugucagugaacaagcccccgcaauuggugaggccgcccucuuacauuauguugacccagacaccaaucgaaaccugggugaauucaaauuguauccugagggcuuuaucaccuguguccccaauggcacugguccucagcagcucccccugaauggagucuuugucuuuucuuccuggguaucaagguuuuaucaacucaagccugugggaacggcuucuucagccagauaa

SEQ ID NO: 8468 - RNA, 1605 nt, Artificial Sequence
  VP1__Norovirus_and/or_Norovirus-like__AB081723
augaugauggcgucuaaggacgccccaacauccccugauggcgccaguggcgcuggccagcugguaccggaggcuaauacagcugagcaaauuucaauggacccuguugcgggugcuucaacagcagucgcaacagcugggcaaguuaauaugauugacccauggauuuucaauaacuucguccaggcaccccaaggagaauuuacuauuuccccuaauaauacccccggugacauuuuguuugauuuacaauuaggaccccaccuuaauccauuucuagcccaccucucacaaauguauaaugguugggucggcaauaugcguguacguauauuguuggcagggaaugcuuuuacagcugguaagauaaucauuugcuguguccccccuggcuuugaugcuagaauacuuacaauagcccaagcaacucucuuuccacacuugauugcugauguuaggacucuugagccuguggagcucccucuggaggacgugcgcaacguucucuaucacaacagcagccagccgcagccaacaaugcgguugguagcuauguuguacacuccccuccgcacuggugguggcuccggagguacugaugccuuugugguugcgggcagggugcucacgugccccgccccugauuucagcuuucuguuucucgucccccccuccguugagcagaagacuaggguuuuuaguguccccaacauaccccugaaagaccuuucaaauucucgugucccugugccuauacagggcauguucauguccccagaugucaaucagucaguccaguuccagaacgggcgcugccagaucgauggucaacuccagggcacuaccccugucucgcucagucaacuuugcaagauuagggguaagacuucaagcaaugccaggguacucaacuuaagugagguggauggcacacccuuuaucccucuugagucuccagcaccaguugguuuucccgacuuaggagguugugacuggcauguaaacuucacuuuccaggcucagaaucaggacccaucucaaagugugaccuuugcaacuaaugaugcuagcuuuguucccuacuuaggcagcauuucuccucacaaugggggggauuuucaugcaggugacaucauaggcagccuuggcuggauuucagccccgucugacaauacacaacuuaaugucuggacaauaccaaaguaugggucuagucuccagaugucacucaccuugcaccugcuguguucccccaggcuuugggaggugauucuguacuucuacucuacauucccagguucuggacaaccuagucagcuucaagugccaugccuguugccucaggaguucaucacccacuucugcaaugaacaggcucccaucgcuggggaagcugcucuccuccauuacguggacccugacacgggacggaaccugggggaauucaaacucuauccugauggguucaugaccuguguccccaauaguguuaguaguggcccucaaacccuuccuaucaauggagucuuugucuuuguuucauggguauccagauuuuaucaacucaagccugugggaacggccucagcggcuagaaggcuuuaa

SEQ ID NO: 8469 - RNA, 1605 nt, Artificial Sequence
  VP1__Norovirus_and/or_Norovirus-like__JN005886
augaugauggcgucuaaggacgcccccucaaacauggauggcacuaguggugccggucagcugguuccagagguuaaugcagcugaaccccuaccccuugaaccgguagugggcgccgcaacugcggcagccacugcuggacaagucaauuuaauagaccccuggauuaugaauaauuuuguccaagccccugagggcgaauuuaccauuucacccaauaauaccccuggagacauuuuguuugaucugcauuugggaccacaucuuaauccuuuccuacaacauuuaucacaaauguauaaugguuggguggggaacaugagagucagaguuaugcuagcggggaacgcguucacugcugguaaaaucauaauuuguugugucccaccagguuuugcuucccaaaacauaucaauuggacaagcuacgauguucccccauguaauagcagaugugaggguauuggagccaauugaaaucccccuugaugauguacgcaauguuuuguuucauaccaaugagaaucgccccaccaugcgguuacucugcaugcuguacacaccccuccgugcuggaggagcuucaucaggcacagauccuuuugucaucgcaggucgugugcuaacuugcccuucucccgauuucaacuuccuguuucucgugccuccuaguguggagcagaaaaccaggcaacuaacugugcccaauauacccuugaacaauuuggcuaacuccagagugccugcaaugauaaauaaaaugacaguuucuacugaccaaaaucagguaguccaguuccaaaauggccguugcacacucgaagggcaacuuuugggcacaaccccugucucagcuagucaaguggcccgcauacguggcaaaguuuucuccacugcaucaggaaaaggacucaaccuaacugaguuagauggaaccccuuaccaugcauuugagaguccagccccccuuggcuucccugauauaggagccugugauuggcaugugucaacuuuuaaaguggaucaaaaucuuucgggggaucccauguccagauuagauguaaagcaaaaugccccauuugcaccacaccuaggcucuauugaauucacuucugaccaagacccaacuggggaccaauuagguacacuagccugggucucucccuccaccaguggagcuaggguugacccauggaagaucccaucauauggcucaacagugacugaguccacccaucuggcaccaccuauuuuuccaccagguuuuggugaagcuauagucuauuuuaugucagauuuuccuauugugucaggcaacacugcucaaguucccugcacucuaccccaggaguuuguuucacacuuuguggaacaacaggcaccaguccgaggugaagccgcccuauuacauuauguggacccagauacccaccguaauuugggagaguuuaaauuauacccugauggguucaucaccugugugccaaauacaggugguggcccccaaaaucuuccuacaaaugggguuuuugucuuuucuucuuggguuucuagauauuaucaacuaaagccugugggaacagccgguccggcuaggaggcuuuaa

SEQ ID NO: 8470 - RNA, 1605 nt, Artificial Sequence
  VP1__Norovirus_and/or_Norovirus-like__AB758449
augaugauggcgucuaaggacgcccccucaaacauggauggcacuaguggugccggucagcugguuccagagguuaaugcagcugaaccccuaccccuugagccgguggugggugccgcaacugcggcggccacugcugggcaaguuaauuuaauagaccccuggaucaugaauaauuuuguccaagccccugagggcgaauucacuaucuccccuaauaauaccccuggagauauuuuauuugauuugcaauugggaccacaucuuaacccuuuccuucaacauuugucucaaauguauaaugguuggguggggaacaugagagucagagucaugcucgcagggaacgcguucacugcugguaagaucauaauuuguugugucccgccuggcuuugcaucccaaaacauaucaauuggacaagccacaauguuuccacauguuauagcugaugugagaguauuagaaccuauugaaaucccccuugaugauguacgcaaugucuuauuccacacuaaugaaaaccgcccaacuaugcgguuacucugcaugcuguacacaccccuccgugcuggaggugcuucaucaggcacggacccuuuuguuauugcaggucguguccuaaccugcccuuccccugacuucaauuuucuguuccucguaccuccuaguguggaacagaagaccaggcaauuaacugugcccaacauacccuugaauaauuuggccaacuccagagugccugcaaugauaaacaagaugacaguuucuacugaucaaaaucagguaguccaguuccaaaauggucguugcacacucgaagggcaacuuuugggcacaaccccugucucagcuagucaaguagcccgcauacgcgguaaaguuuucuccacugcaucugggaagggacuuaaucuaacugagcuggauggaaccccuuaucaugcauuugagagcccagccccccuuggcuuuccugacauaggagccugugauuggcaugugucaacuuuuaagguggaucaaaaucuuucgggggaccccauguccaggcuagauauaaaacaaaaugccccauuugcaccacaucuugguuccauugaauucaccucugaccaggagccaaccggggaucaauugggcacacuagcuugggucucccccuccacuaguggagcuagggucgauccuuggaaaauuccaucauaugguucaacuguaacugaguccacucaccuggcaccaccuaucuuuccaccagguuuuggugaagccauagucuauuuuaugucagauuuuccuauugugucggguaacacugcucaaguucccuguaccuuaccucaagaauuuguuucacacuuuguagaacagcaggcaccaauucgaggugaagcugcccuacugcauuauguagauccagacacccaccguaauuugggagaguuuaaauuauacccugauggguucaucaccugugugccaaauacaggcgguggcccccaaaaccuuccuauaaauggagucuuugucuuuucuucuuggguuucuagauauuaccaauuaaagccugugggaacagccgguccggccaggaggcuuuaa

SEQ ID NO: 8471 - RNA, 1605 nt, Artificial Sequence
  VP1__Norovirus_and/or_Norovirus-like__KX907729
augaugauggcgucuaaggacgcccccucaaacauggauggcacuaguggugccggucagcugguuccagagguuaaugcagcugaaccccuaccccuugagccgguggugggugccgcaacugcgguggccacugcugggcaaguuaauuuaauagaccccuggaucaugaauaauuuuguccaagccccugagggcgaauucacuaucuccccuaacaauaccccuggagauauucuauuugauuugcaauugggaccacaucuuaauccuuuucuucaacaucugucccaaauguauaaugguugggugggaaacaugagaguuagagucaugcucgcaggaaaugcguucacugcugguaaaaucauaauuuguugugucccaccuggcuuugcaucccaaaauauaucaauuggacaagccacaauguucccacauguuauagcugaugugagaguauuagaaccuauugaaaucccccuugaugauguacgcaaugucuuguuucacaccaaugaaagccgcccaacuaugcgguuacucuguaugcuguacacaccccuccgcgcuggaggcgcuucaucaggcacggacccuuuugucauugcaggucguguccuaaccugcccuuccccugauuucaauuuucuguuccucguaccuccuagcguggaacagaagacuaggcaauugacuguacccaauauacccuugaacaauuuggccaacuccagagugccugcaaugauaaauaagaugacagucuccacugaucaaagucagguaguccaguuccaaaauggucguugcacacucgaggggcaacuuuugggcacaaccccugucucagcuagucaaguggcccgcauacgcgguaaaguuuucuccacugcaucugggaaagggcucaauuuaacugaauuggaugggacccccuaucaugcauucgagagcccagccccccuugguuuuccugacauaggagcuugugauuggcaugugucaacuuucaagguggaucaaaaucuuucaggggaccccauguccaggcuagauauaaaacaaaaugccccguuugcaccacaucuugguuccauugaauucaccucugaccaggaaccaaccggggaucaauugggcacacuagcuugggucuccccuuccacuaguggagcuagggucgauccuuggaaaauuccaucauaugguucaacuguaacugaguccacucaccuggcaccaccuaucuuuccgccagguuuuggugaagccauagucuauuucaugucagacuuucccauugugucaggcaacacugcucaaguucccuguaccuuaccucaagaauuuguuucacacuuuguggaacaacaggcaccaauucgaggugaagcugcccuauugcauuauguagauccagacacccaccguaauuugggagaguucaaauuguacccugauggguucauuaccugugugccaaauacaggcgguggcccccaaaaccuuccuauaaaugggguuuuugucuuuucuucuuggguuucuagauauuaccaauuaaagccugugggaacagccgguccggccaggaggcuuuaa

SEQ ID NO: 8472 - RNA, 1602 nt, Artificial Sequence
  VP1__Norovirus_and/or_Norovirus-like__JN899243
augaugauggcgucuaaggacgcccccucaaacauggauggcaccaguggugccggucagcuaguuccagagguuaauacagcugaaccucuaccccuugaaccgguggugggcgccgcaacugcggcggccacugcuggacagguuaauuuaauagaccccuggaucaugaauaauuuuguccaagccccugaaggcgaguucacuauuucacccaacaauacccccggagauauuuuauuugauuugcgucuggggccacaccuuaaccccuuccuccuacauuugucccagauguauaaugguuggguugggaacaugagaauuagggucaugcuugcagggaacgcguucucugcugguaagaucauaauuuguugugucccaccuggcuuugaaucccagaacauaucaauuggacaagccacuauguucccccaugucauagcugauguaagaguccuggagcccauagagaucccccuugaugaugugcgcaauguccuguaccacacaaaugagaaccgcccaaccaugcgauugcucugcauguuauacacaccucuccgugcuggaggagcuucaucaggcacagacccuuuugucauugcuggccguguguuaacuugcccugccccugacuuuaauuuucuguuucuugugccccccaguguagaacagaaaaccaggcaauugacuauacccaauauacccuugaacaauuuggcuaacuccagagugccugcaaugauaaacaagauggcagucucugcugaucagaaucaggugguccaguuucaaaauggccguugcacacuugaaggacaacucuuagguacaacuccuguuucagccaaccaaguugcccgcauacguggcaaagucuucuccaccaacuccgggacgggacuuaauuuaacugaaacagauggaacccccuaccaugcauuugagagcccggccccucucgguuuuccugauauaggugauugugauuggcauguguaugcuuuuaaggugaaucaaaacacaggggaucccauguacagauuggauauaacacaaggaaacucauuugcgccgcaucuuggcuccaucgaguuuacuucugaucagcacccaucaggagaucaauuaggcacacuuacuuggaucuccccucucaacaaugccuccaggguugaucccuggaaaaucccaucauaugguucaacauugacugaguccacuaaccuggcaccacccaucuuuccaccaggcuuuggugaggccauagucuacuucaugucagauuucccuauugugucagguaacacuacccaaauccccuguacccugccccaagaguucaucucauccuuuguggaacaacaggcaccaauccgaggugaggcugcucuacugcauuauguggacccagauacccaucgcaaucugggagaauucaaacuguacccugauggguucaucacuugugugccaaacacggguggcggcccccaaaaccucccuucaaaugguguuuuuaucuuuucuucuugggucucuagauauuaucaauugaagccugugggaacagccgguccggcuaggcggcuuuaa

SEQ ID NO: 8473 - RNA, 1602 nt, Artificial Sequence
  VP1__Norovirus_and/or_Norovirus-like__AB810004
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcucccccauuugaucguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuaguuccucccucuguagaguccaaaacuaaaccauucacacuuccaauauugaccauuucugaacuaaccaacucccgguuccccaucccaauugagcaacuguacacggccccaaaugagaauaauguuguacagugucaaaauggaaggugcaccuuggauggagagcuucagggcaccacccagcuacuaucaagugcagucugcucuuacaggggcaggacuguggcuaacagaggggacaauugggaccagaauuugcuccagcugaccuacccaaguggugcaagcuaugaccccacugaugaagugccagcaccuuugggcacccaggauuucagugggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggaguugcucagaaugaaaacacccccuuccagcaauggguucuaccacacuacgcaggugcucucgcucuaaacaccaauuuggcacccgcuguugccccgacuuucccuggcgagcaauuacuguucuucaggucucguguuccauguguucaaggccugcgcgggcaggaugcuuucauagauugucuccuaccucaagagugggugaaucauuuuuaucaagaggcugcucccucccaagcagacguugcccucaucagguaugucaacccugauacuggucgcacgcuguuugaggccaaauugcauaggucagguuuuauuacuguaucacacacuggugccuacccucuugugguccccccaaauggucauuucagguuugauucuuggguuaaucaauucuacucacucgcccccaugggauaa

SEQ ID NO: 8474 - RNA, 1602 nt, Artificial Sequence
  VP1__Norovirus_and/or_Norovirus-like__JN183163
augaugauggcgucuaaagacgcuacaccaagcgcagauggcgccacuggcgccggccagcugguaccggagguuaauacagcugacccuauacccauugacccuguggcuggcuccucuacagcccuugccacugcgggccaaguuaauuugauugaucccuggauaaucaauaauuuugugcaagccccucagggcgaguucacaauauccccaaauaauacccccggugaugugcuauuugauuugcaguuagggccucaucugaauccuuuccuuucccaucuuucucagauguacaauggcugggugggcaacaugcgaguacguguuguuuuggcugguaaugcuuuuacagcuggaaagguuauaauuuguuguguucccccuggcuuucaaucucgcacucuuuccauagcucaggcuacucuauuuccccauguuauugcugauguuaggacccuugacccuguagaagugccccuugaagauguuaggaauguguuguaucacaauaaugacacccaaccuaccaugcgccuccuuugcauguuguacaccccucuucgaacugggggggcgucuggugggacugauucuuuugugguagcugggcgugugcuuacuugcccaggcccugacuuuaacuucuuauuccuagucccuccuacagucgagcaaaagacucgcccuuuuacugugccuaauaucccuuugaaguaucugucuaauucuaggaucccaaacccuauugaggguaugucuuugucaccugaccagacccaaaauguucaauuccagaaugguagguguacaauugacggucagccccucgggaccacaccugucucaguuagccaguuauguaaguuuagggguaggauuacaucuggacagagggugcucaauuugacagaguuagaugguucaccuuuuauggccuuugccgcccccgcccccgcgggcuuuccagaucucggaucuugugauuggcauauugaaaugaguaaaauuccaaacuccagcacccagaacaauccaauaguaguuaauucugucaaacccaauagucaacaguuugucccgcauuugucaaguaucacccuugaugauaauguuucuagugggggugacuauauuggcacuauacaauggaccucuccuccuucugauuccggcggagccaacacaaauuuuuggaagauuccugacuaugggucuagucuagcagaagccucacagcuggcccccgcugucuauccaccugguuucaaugaggugauuguguacuuuauggcaucuauaccuggucccaaucaaucugguucccccaauuuggugccaugccuucucccccaggaauauauaacacauuuuaucagugagcaggcccccauucagggugaggcugccuuacuccauuauguagacccagacaccaaucguaauuugggugaguucaaauuguauccuggugguuaucugacuuguguuccuaauaguucuaguacaggaccucaacagcuuccucuugaugguguguuugucuuugcuucuuggguuucuagauuuuaucaauuaaagccugugggaacugccuaa

SEQ ID NO: 8475 - RNA, 1599 nt, Artificial Sequence
  VP1__Norovirus_and/or_Norovirus-like__EU373815
augaagauggcgucgaaugacgcuaguccguccagugacggaucagccaaccucgucccagagaucaacaaugagguaauggcccuugaaccaguggcuggugcugcuauugcugccccgguugcugggcagcaaaauauaauagaucccuggauuagaaacaauuuugugcaggccccugguggugaguucaccguuucaccaagaaacgccccgggggaagugcuucuaaauuuaccuuuaagcccugauaucaauccauauuuggcccauuugucccgaauguauaaugguuaugcuggagguguggagguggaggugguccucgccgggaaugcguucacggcgggaaaaaucaucuuugccgcagugccacccaauuuuccuccugagaaccuuaguccaagucaaauaacaaugcuuccccacauuauaguugaugucaggcaauuagagccagugcgcauaccccuaccagaugugcgcaacaauuucuaucauuauucuagagaaaaugauucuacauugagauugguugcaaugcuguacacuccccuuagagcuaauaaugcuggugaugauguguucacugucucuuguagaguguugacaaggccuucuccugauuuugauuuuauauuccuggugccacccacgguugaaucuaaaucuaagcccuucaccaucccaauacucacuauugaggaaaugaccaauuccagguucccugcuccguuagagaugaugaccacaggaccgagccacgacauuguugugcagccacaaaacggacgcugcaccauugaugguguguugcucggcacuacacagcuguccccaguuaacaucugcuccaugagggguguccccaccaagcgaaccaaugggacugauaauugcuuuguacaacuugagaauccaaaugguucagcuuaugauccaacagaggacauaccugcaguucuggggucaccugacuuugugggagaguucuacgggacaaucacccagagaagcccaaacaauucaacuagagcccacccuuuuacccuuaauacuggaagcccuagguacacucccaaaauuggcucaguggacauccaugucacagacguugaugaccucaacgaucacgagccagugaaacucacuccaguuggucucucugggagcagugguucaauccaucaguggcagcuuccaaacuacucaggaguggcaacccacaauaugcacuuggccccaucugucgcuccauuguucccuggugagcagauucuuuucuuccgguccacaguccccggguguggugguuacccaaacacaaacaucgacuguuugauuccucaagaguggguucaacacuucuaccaggaaggugcuccagcccguaccgauguggccuugcucagguucauaaacccugacacgggcagagugcucuuugagugcaaauugcauaaacauggcuucaucacuguggcuuauucuggaaaucaugauuugguuaugcccccaaaugguuacuucagauuugaaucuugggugaaucaauuucacacucuugcccccaugggaacaggucgggcagaagaguaa

SEQ ID NO: 8476 - RNA, 1599 nt, Artificial Sequence
  VP1__Norovirus_and/or_Norovirus-like__KC473547
auggcgucuaaggacgcuccaacauccccugauggcgcuaguggcgccggccagcugguaccggaggcuaauacagcugagcaaaucucaauggacccuguugcgggugcuucaacagcagucgcaacggcugggcaaguuaacaugauugacccauggaucuucaauaacuuuguccaagcgccccaaggagaauucacuauuuccccuaauaauacccccggugauauuuuguuugaucuacaacuaggaccccaucuuaacccauuucuagcccaucucucacagauguauaaugguugggucggcaauaugcgugugcgcauauuguuggccggcaacgccuucacagcuggaaagauaaucauuugcuguguccccccuggcuuugaugcuagaauacucacaauagcucaagcaacucucuucccacauuugauugcugacguuaggacccuugagccuguggagcuuccuuuggaggacguacgcaacguucucuaccacaacaguagccagccgcagccaacaaugcggcugguugcuauguuguauaccccccuccgcacugguggugguucuggaggcacugaugccuuugugguggcgggcagggugcuuacgugccccgccccugacuuuagcuuuuuguuucuuguucccccuuccguugaacaaaagaccagaguuuuuaguguccccaauauaccucugaaagaucucucaaauucucgugucccugugccuauacagggcauguuuauguccccagauguuaaucagucaguccaguuucaaaacgggcgcugccaaauugauggucaacuccagggcaccaccccagucucgcucagccaacucugcaagauuagggguaaaacuucaagcaaugccagggugcucaacuugagugagguagaugguacacccuucaucccccuugaaucaccagcgccaguagguuuucccgacuuaggaggcugugacuggcacguaaauuucucuuuccagacucaagaucgggacccaucucaaagugugaccuuugcaaccaaugaugccagcuuuguucccuaccuagguagugucuccccucacaauggggaagguuuucaagcaggcgacaucauagguagccuuggguggauuucagccccgucugauaauucacaauuuaauguuugggcaauaccaaaguauggaucuagucuccagaugucacccaucuugcuccugcuguguucccccaggcuuugggaggugauccuauauuucuacuccaccuucccagguucuggacaacccagucaacuucaagucccauguuuguuaccucaggaguucaucacccacuucugcaacgaacaggcucccaucgcuggggaggcugcccuccuccacuacguggacccugacacggggcgaaacuugggggaauucaaacuuuauccugauggauuuaugaccugugucccuaauaguguuagcaguggcccucaaacccuucccauuaauggagucuuugucuuuguuucauggguauccagauucuaucaacucaagccugugggaacggccucagcggcuagaaggcuuuaa

SEQ ID NO: 8477 - RNA, 1599 nt, Artificial Sequence
  VP1__Norovirus_and/or_Norovirus-like__GQ266692
augaagauggcgucgagugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugauuugaaucccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcagcuggagccuguguugauccccuuacccgauguuaggaauaauuucuaucacuauaaucaaucaaaugaccccaccaucaaauugauagcaauguuguauacaccacuuagagcuaauaaugcuggggacgaugucuucacaguuucuugucggguucucacgagaccaucccccgauuuugauuucauauuuuuagugccacccacaguugagucaagaaccaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugacccaacagaagaaaucccagccccucuggggacuccagauuucguggguaagauccaaggcgugcucacccaaaccacaaggagggauggcucgacccgcggucacaaagccacagugagcacuggaaguguccaauucaccccaaagcugggcagaauucaauucuccacugauacaagcaaugacuuugaaacuggccaaaacacgagauucaccccagucgguguuguccaggauggcagcaccacccaccaaaaugaaccccaacaauggguacucccaaauuauucagguagagauagucacaaugugcacuuagccccugccguggcccccucuuuuccgggugagcaacuucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagauuugauuccugggucaaccaguucuacacacuugccuccauggcaacuuaa

SEQ ID NO: 8478 - RNA, 1599 nt, Artificial Sequence
  VP1__Norovirus_and/or_Norovirus-like__GQ266693
augaagauggcgucgaaugacgccaacccaucugauggguccacagccaaccucgucccagaggucaacaaugagguuauggcuuuggagcccguuguuggugccgcuauugcggcaccuguagcgggccaacaaaauguaauugaccccuggauuagaaauaacuuuguacaagccccugguggagaguuuacaguauccccuagaaacgcuccaggugaaauacuauggagcgcgcccuugggcccugauuugaauccauaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuagacagcuggagccuguguugauccccuuacccgauguuaggaauaauuucuaucacuauaaucaaucaaaugaccccaccaucaaauugauagcaauguuguauacaccacucagagcuaauaaugcuggggacgaugucuucacaguuucuugucggguucucacgagaccaucccccgauuuugauuucauauuuuuagugccacccacaguugagucaagaaccaaaccauucucugucccaauuuuaacuguugaggagaugaccaauucaagauuccccauuccuuuggaaaaguuguucacgggucccagcaguaccuuuguuguucaaccacaaaauggcaggugcacgacugauggcgugcuccuagguacuacccagcugucuccugucaacaucugcaccuucagaggggaugucacccacauugcaaguacucgaguauacacaaugaaucuggccucccaaaacuggaacaauuaugacccaacagaagaaaucccagccccucuggggaccccagauuucguggguaagauccaaggcgugcucacccaaaccacaaggggggauggcucgacccgcggucacaaagccacagugagcacuggaagugucgaauucaccccaaagcugggcagaauucaauucuccacugauacaagcaaugacuuugaaacuggccaaaacacgagauucaccccagucgguguuauccaggauggcaacaccacccaccaaaaugaaccccaacaaugggcacucccaaauuauucagguagugguagucacaaugugcauuuagccccugccguggcccccucuuuuccgggugagcaacuucuuuucuucagguccacuaugcccggaugcagcggguaucccaacaugaauuuggaaugucuacucccccaggagugggugcagcacuucuaccaagaggcagccccagcacaaucugauguggcucugcuaagauuugugaauccagacacagguaggguucuguuugaguguaagcuucauaaaucaggcuaugucacaguggcucacacuggccaacaugauuuaguuaucccccccaauggcuauuuuagauuugauuccuggaucaaccaguucuacacacuugccuccauggcaacuuaa

SEQ ID NO: 8479 - RNA, 1599 nt, Artificial Sequence
  VP1__Norovirus_and/or_Norovirus-like__EU004673
augaggaugagugauggcgcagcgccaaaagccagcggcucugaagccagcggccaggaucuuguuccuaccgccguugaacaggccguccccauucagcccguggcuggcgcggcucuugccgcccccgccgccgggcaaauuaaccaaauugaccccuggauuuuccaaaauuuuguccaaugcccccuuggugaguuuuccauuucaccucgaaacaccccaggugaaauauuguuugauuuggcccucggaccaggacucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacgugcuucccacaugucaugugugaugugcgcacccuggagcccauucaacucccucuucuugacgugcgucgaguucuuuggcaugcuacccaggaucaggaggaaucuaugcgccuggucugcaugcuguacacgccacuccgcacaaacagcccgggugaugagucuuuuguggucucuggccgccuucuuucuaagccggcagcugauuucaacuuuguauaccugaccccccccauugagaggaccauuuaucggauggucgacuugcccguguugcagccgcggcugugcacgcacgcucguuggccagccccggucuauggccucuuaguagauccaucccucccguccaauccccaauggcagaauggaagagugcauauugaugggacccuccuuggcacaacacccgucucugggucuuggguuuccugcuuugcagcugaggccgcauaugaguuccagucugggacgggugagguggcaacuuucacccugauugagcaggacggguccgccuacgucccuggugauagggcggccccucuugguuaccccgacuucucugggcaacuggagauugaggugcagacugagaccaccagggcaggugacaagcugaaggugaccaccuuugagaugauccuuggucccaccaccaacguggaccaagcgcccuaccagggcaggguauacgcuagccugacggcugcggccucccuugaccugguagauggcagaguuagggcaguuccacgcucuaucuauagcuuucaggaugugcuccccgaauauaaugauggucuuuugguuccccuugcccccccaauuggccccuuccuccccggugaagugcuucugagguuccgaaccuacaugcgccagguugacagcucugacgccgcagcagaggccauugacugcgcccuuccacaggaguucgucucgugguucgcgagcaacggauucacggugcagucggaggcccugcuccucagguacaggaacacccucacagggcaguugcuguuugagugcaagcucuacagcgaagguuauaucgcccuguccuauucgggcucaggaccgcucaccuucccaacugauggcuucuuugagguugucagcugggucccccgccuuuuucaauuggccucugugggaagcuaa

SEQ ID NO: 8480 - RNA, 1599 nt, Artificial Sequence
  VP1__Norovirus_and/or_Norovirus-like__AB601769
augaggaugagugauggcgcagcgccaaaagccaacggcucugaagccagcggccaggaucuuguucuuaccgccguugaacaggccguccccauucagcccguggcuggcgcggcucuugccgcccccgccgccgggcaaaucaaccaaauugaccccuggaucuuccaaaauuuuguccaaugcccccuuggugaguuuuccauuucaccucgaaacaccccaggugaaauacuguuugaucuggcccucggaccagggcucaaccccuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugacgugcgucgaguucuuuggcaugcuacccaggaucaggaggaaucuaugcgccuggucugcaugcuguacacgccacuccgcacaaacagcccgggugaugagucuuuuguggucucuggccgccuucuuucuaagccggcagcugauuucaacuuuguauacuugaccccccccaucgagaggaccaucuaccggauggucgacuugcccguguuacagccgcggcugugcacgcacgcacguuggccugcuccggucuauggccucuugguagacccaucccuccccuccaauccccaguggcagaauggaagagugcauguugauggaacccuccuuggcacaacgcccgucucugggucuuggguuuccugcuucgcagcugaggccgccuacgaguuccaguccgggacuggugagguggcaaccuucacucugauugagcaggacggguccgccuacgucccuggcgagagggcggcuccccuuggcuaccccgacuucuccgggcaacuggagaucgaggugcagacugagaccaccaagagaggugagaagcugaaggugaccaccuuugagaugauucuuggccccaccaccaacguggaccaagcgcccuaccagggcaggguguacgcuagccuaucggcugcggccucccucgaccugguggaugguagaguuagggcagucccacgcucuaucuauggcuuccaggaugugauaccugaguacaaugauggucuucugguuccccuugcccccccaauuggucccuuccuucccggugaagugcuccugagguuccgaaccuacaugcgucagguugacagcucugacgccgcagcggaggccauugacugcgcccuuccacaagaguucgucucgugguuugcgaguaacggauucacggugcagucagaggcccugcuccuuagguacaggaacacccucacagggcaauugcuguuugagugcaagcucuacagcgaaggcuacaucgcccuguccuauucgggcucaggaccacucaccuucccgacugauggcuucuucgagguugucagcugggucccccgccucuaucaauuggccucugugggaagcuaa

SEQ ID NO: 8481 - RNA, 1599 nt, Artificial Sequence
  VP1__Norovirus_and/or_Norovirus-like__EU004676
augaggaugagugauggcgcagcgccaaaagccaacggcucugaagccagcggccaagaucuuguuccuaccgccguugaacaggccguccccauucagcccguggcuggugcggcucuugccgcccccgccgccgggcaaaucaaccaaauugaccccuggaucuuccaaaauuuuguccaaugcccccuuggugaguuuuccauuucgccucgaaacaccccaggugaaauacucuuugauuuggcccucgggccagggcucaaccccuaccuugcccaccucucagccauguacaccggcuggguugggaacauggagguucagcugguccucgccggcaaugccuuuacugcuggcaaggugguuguugcccuuguaccacccuauuuccccaaagggucacucaccaccgcccagaucacaugcuucccacacgucaugugugaugugcguacccuggagcccauucaauugccucuucuugacgugcgucgaguucuuuggcaugcuacccaggaucaggaggaaucuaugcgccuggucugcaugcuguacacgccacuccgcacaaacagcccgggugaugagucuuuuguggucucuggccgccuucuuucuaagccggcaccugauuucaacuuuguauaccugacccccccuaucgagagaacuauuuaccggaugguugacuugcccguguugcagccgcggcugugcacgcacgcucguuggccggccccggucuauggccucuugguagacccaucccucccauccaauccccaguggcagaaugguagagugcaaguugaugggacucuucuugguacaacgccugugucugguucauggguuuccugcuuugcagcugaggcugccuacgaguuccaagcugggacuggugagguggugaccuucaccaugauugagcaggacggauccgccuauguccccggugacagggcggccccccuuggguaccccgacuucucugggcaacuggagaucgaggugcagacugagaccaccaaaacaggcgacaagcucagggugaccaccuucgagaugauccuuggccccaccaccaacguggaccaggcccccuaccagggcagagcguacgcgagcuuaacagcugcagccucgcuugaccugguggaugggagaguuagggcggucccacgcuccaucuauucuuuccaggaugagcucccagaguauaaugauggucuuuugguuccccuugccccaccccuaggccccuuucuuccuggugagguuuuguugagguuucguaccuacaugcgccagcuugacaccgcugacgccgcagcgcagccgaucgacugugccuugccccaggaguuuaucuccugguuugcaagcaacaacuucacgguccagucggacgcgcuccugguuagguaccggaauaccuugacuggccagcuccuguuugaggcuaagcuuuauagugaaggcuacauugcugugucuuacucagggucuggcccccucacuuuccccacugacggcuucuuugagguugucagcugggucccccgccucuuucaauuggccuccgugggaagcuaa

SEQ ID NO: 8482 - RNA, 1599 nt, Artificial Sequence
  VP1__Norovirus_and/or_Norovirus-like__JQ237823
augaggaugagugauggcgcagcgccaaaagccaacggcucugaagccagcggccaagaucuuguuccuaccgccguugaacaggccguccccauucagcccguggcuggugcggcucuugccgcccccgccgccgggcaaaucaaccaaauugaccccuggaucuuccaaaauuuuguccaaugcccccuuggugaguuuuccauuucgccucgaaacaccccaggugaaauacucuuugauuuggcccucgggccagggcucaaccccuaccuugcccaccucucagccauguacaccggcuggguugggaacauggagguucagcugguccucgccggcaaugccuuuacugcuggcaaggugguuguugcccuuguaccacccuauuuccccaaagggucacucaccaccgcccagaucacaugcuucccacacgucaugugugaugugcguacccuggagcccauucaauugccucuucuugacgugcgucgaguucuuuggcaugcuacccaggaucaggaggaaucuaugcgccuggucugcaugcuguacacgccacuccgcacaaacagcccgggugaugagucuuuuguggucucuggccgccuucuuucuaagccggcaccugauuucaacuuuguauaccugacccccccuaucgagagaacuauuuaccggaugguugacuugcccguguugcagccgcggcugugcacgcacgcucguuggccggccccggucuauggccucuugguagacccaucccucccauccaauccccaguggcagaaugguagagugcaaguugaugggacucuucuugguacaacgccugugucugguucauggguuuccugcuuugcagcugaggcugccuacgaguuccaagcugggacuggugagguggugaccuucaccaugauugagcaggacggauccgccuauguccccggugacagggcggccccccuuggguaccccgacuucucugggcaacuggagaucgaggugcagacugagaccaccaaaacaggcgacaagcucagggugaccaccuucgagaugauccuuggccccaccaccaacguggaccaggcccccuaccagggcagagcguacgcgagcuuaacagcugcagccucgcuugaccugguggaugggagaguuagggcggucccacgcuccaucuauucuuuccaggaugagcucccagaguauaaugaugguguuuugguuccccuugccccaccccuaggccccuuucuuccuggugagguuuuguugagguuucguaccuacaugcgccagcuugacaccgcugacgccgcagcgcagccgaucgacugugccuugccccaggaguuuaucuccugguuugcaagcaacaacuucacgguccagucggacgcgcuccugguuagguaccggaauaccuugacuggccagcuccuguuugaggcuaagcuuuauagugaaggcuacauugcugugucuuacucagggucuggcccccucacuuuccccacugacggcuucuuugagguugucagcugggucccccgccucuuucaauuggccuccgugggaagcuaa

SEQ ID NO: 8483 - RNA, 1599 nt, Artificial Sequence
  VP1__Norovirus_and/or_Norovirus-like__DQ223043
augaggaugagugauggcgcagcgccaaaagccaacggcucugaagccagcggccaggaucuuguuccuaccgccguugaacaggccguccccauucagcccguggcuggugcggcucuugccgcccccgccgcugggcaaaucaaccaaauugaccccuggaucuuccaaaauuuuguccaaugcccccuuggugaguuuuccauuucaccucgaaacaccccaggugaaauacuguuugauuuggcccucgggccagggcucaaccccuaccuugcccaccucucggccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcacccuggagcccauucaacucccucuucuugacgugcgucgaguucuuuggcaugcuacccaggaccaggaggaaucuaugcgccugguuugcaugcuguacacgccacuccgcacaaacagcccgggugaugagucuuuuguggucucuggccgccuucuuucuaagccggcaucugauuucaacuuuguauaccugaccccccccaucgagagaaccauuuaccggaugguugacuugcccguguugcagccgcggcugugcacgcacgcucguuggccggccccggucuauggccucuugguagacccaucccuuccauccaacccccaguggcagaaugguagaguacauguugaugggacucuucuugguacaacaccugugucuggcucuuggguuuccugcuucgcagcugaggccgccuacgaguuccagucugggacuggugagguggcgaccuucaccaugauugagcaggacggguccgcuuacgucccuggcgacagggcggccccccucggguaccccgacuucuccgggcaacuggagaucgaggugcagacugagaccaccaagacgggcgacaaacucaaggugaccaccuuugagaugauccugggccccaccaccaacguggaccaggcccccuaccagggcagggcguacgcgagccugacggcugcggccucgcucgaccugguggaugggagaguuagggcggucccgcgcuccgucuacucuuuccaagacgagcucccagaauauaaugauggucuuuugguuccccuugccccaccccuaggucccuuccuuccuggugagguucuguugagguuucgcaccuacaugcgccagcucgauaccgcugacgccucagcgcaaccgaucgacugugccuugccccaggaguucaucuccugguuugcaagcaacaacuucacaguccagucggacgcgcuccugguuagguaccggaacaccuuaaccggucagcuucuguuugaggcuaagcuuuauagugaaggcuauauugcuguguccuauucagggucuggcccccucaccuuccccacugacggcuucuuugagguugucaguugggucccccgccucuuucaauuggccucugugggaagcuaa

SEQ ID NO: 8484 - RNA, 1599 nt, Artificial Sequence
  VP1__Norovirus_and/or_Norovirus-like__JX048594
augaggaugagugauggcgcagcgccaaaagccaacggcucugaagccagcggccaggaucuuguuccuaccgccguugaacaggccguccccauucagcccguggcuggugcggcucuugccgcccccgccgccgggcaaauuaaccaaauugaccccuggaucuuccaaaauuuuguccagugcccccuuggugaguuuuccauuucaccucgaaacaccccaggugaaauauuguuugauuuggcccucgggcccgggcucaacccuuaccuugcccaccucucagccauguacaccggcuggguugggaacauggagguucagcugguccucgccggcaaugccuuuacugcuggcaaggugguuguugcccuuguaccacccuauuuucccaaagggucacucaccacugcucagaucacaugcuucccacaugucaugugugaugugcgcgcccuggagcccauucaacucccucuucuugacgugcgucgaguucuuuggcaugcuacccaggaucaagaggaaucuaugcgccugguuugcaugcuguacacgccacuccgcacaaacagcccgggugaugagucuuucguggucucuggccgccuucuuucuaagccggcagcugauuucaauuuuguauaccugaccccucccaucgagagaaccauuuaucggaugguugacuugcccguguugcagccgcggcugugcacgcacgcucguuggccagccccggucuauggccucuugguugacccaucccucccaucgaacccccaguggcagaauggaagagugcauguugauggaacccuccuuggcacaacaccugucuccgguuccuggguuuccugcuuugcagcugaggccgcuuacgaguaccagucugagguuggugagguggcaaccuucacucugauugagcaggauggauccgccuacguccccggcgacagagcggcuccccuuggguaccccgacuacuccgggcagcuggagaucgaggugcagacugagaccaccaagacaggagacaagcuuaaggucaccaccuuugacaugauccuuggccccaccaccaacguggaccagguccccuaccaggguaagguguacgcgagccugacgaccgcgucuucacuugaccugguggaugggagagccagggcagucccccgcucugucuacuccuuccaggaugugcuuccagaguacaaugauggucuuuuggucccccuugccccgcccuuaggccccuaccuaccuggugagguucugcugagguuucggaccuacaugcgccagcuugacaccgcugacgccgcagcgcagccgaucgacugugccuugccucaggaauucaucuccugguuugcaagcaacaacuucacgguccaaucggaugcgcucuugauuagguaucgaaauaccuugacuggccagcuccuguuugaggcuaagcuuuauagcgaaggcuacauugcugugucuuauucggguuccggcccccucaccuuccccacugacggcuucuucgagguugucagcugggucccccgacucuuucaauuggccucugugggaagcuaa

SEQ ID NO: 8485 - RNA, 1596 nt, Artificial Sequence
  VP1__Norovirus_and/or_Norovirus-like__GQ266691
augaagauggcgucgagugacgccaacccaucugauggguccacagccagccucgucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguaucccccagaaacgcuccaggugaaauacuauggagcgcgccccugggcccugauuugaaccccuaccuuucccauuuagccagaauguacaaugguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuagacaacuggaaccuguguugaucccccuacccgauguuaggaacaauuucuaucacuauaaucaaucaaaugaccccaccaucaaauugauagcaauguuguauacaccacuuagggcuaauaaugcuggggacgaugucuuuacaguuucuugucggguucucacgagaccaucccccgauuuugauuucauauuuuuagugccacccacaguugagucaaggacuaaaccauucucugucccaauuuuaacuauugaggagaugaccaauucaagauuccccaucccuuuggaaaaguuguucacgggucccagcagugccuuuguuguucaaccacaaaauggcaggugcacgauugauggcgugcuccuagguacuacccaacugucuccugucaacaucugcaccuucagaggggaugucacccacauugaagguucuaaaguauacacaaugaaucuggccucccaaaacuggaacaauuaugacccaacagaagagaucccagccccucugggaacuccagauuucaaggguaggauucaaggcgugcucacccaaaccacaaggagugauggcucgacccguggucacacagccacagugagcacuggaagugccgaauucaccccaaagcugggcagaauccaauucucuacugauacaaacaaugauuuugaaacuggccaaaacacgaaauucaccccagucgguguuguccagaaugguaguaccacccaccaaaaugaaccccaacaaugggaacucccagauuacucagguagagguauucacaaugugcaccuagccccugccguggcccccacuuauccgggugagcaaauucuuuucuucagguccaccaugcccggaugcagcggguaucccaacaugaauuuggauugccuacucccccaggauugggugcggcacuucuaccaagaggcagccccagcacaaucugauguggcucuucuaagauuugugaauccagacacagguaggguucuguuugaguguaagcuucauaaaucaggcuaugucacaguagcacacacuggccaacaugauuuagucaucccccccaaugguuauuuuagauuugauuccugggucaaccaguucuacacacuugcccccaugggauaa

SEQ ID NO: 8486 - RNA, 1596 nt, Artificial Sequence
  VP1__Norovirus_and/or_Norovirus-like__GQ266690
augaagauggcgucgagugacgccaacccaucugauggguccacagccaaccucgucccagaggucaacaaugagguuauggcuuuggagcccguuguuggugccgccauugcggcaccuguagcgggccaacaaaauguaauugaccccuggauuagaaauaauuuuguacaagccccugguggagaguuuacaguaucccccagaaacgcuccaggugaaauacuauggagcgcgcccuugggcccugauuugaaccccuaccuuucccauuuggccagaauguacaauaguuaugcaggugguuuugaagugcagguaauccucgcggggaacgcguucaccgccggaaaaaucauauuugcagcagucccaccaaauuucccaacugaaggcuugagccccagccaggucacuauguucccccauauaauaguagauguuaggcaacuggaaccuguguugaucccccuacccgauguuaggaauaauuucuaucacuacaaucaaucaaaugaccccaccaucaaauugauagcaauguuguacacaccacuuagggcuaauaaugcuggggacgaugucuucacaguuucuugucggguucucacgagaccaucccccgauuuugauuucauauuuuuagugccacccacaguugagucaagaacuaaaccauucucugucccaauuuuaacuguugaggagaugaccaauucaagauuccccauuccuuuggaaaaguuguucacgggucccagcagugccuuuguuguucaaccacaaaauggcaggugcacgacugauggcgugcuccuagguacuacccaacugucuccugucaacaucugcaccuucagaggggaugucacccacauugcagguacucaagaauacacaaugaaucuggccucccaaaacuggaacaauuaugacccaacagaagaaaucccagccccucugggaacuccagauuucguggguaggauccaaggcgugcucacccaaaccacaaggagggauggcucgacccguggucacaaagccacagugagcacuggaaguguccacuucaccccaaagcugggcagaauucaauucuccacugauacaagcaaugauuuugaaacuggccaaaacacgagauucaccccagucgguguuguccaggauggugguaccacccaccaaaaugaaccccaacaauggguacucccaaauuauucagguagagauggucacaaugugcaccuagccccugccguggcccccucuuuuccgggugagcaaauucuuuucuucagguccacuaugcccggaugcagcggguaucccaacaugaauuuggauugccuacucccccaggagugggugcagcacuucuaccaagaggcagccccagcacaaucugauguggcucugcuaagauuugugaauccagacacagguaggguucuguuugaguguaagcuucauaaaucaggcuaugucacaguagcucacacuggccaacaugauuuagucaucccccccaauggcuauuuuagauuugauuccugggucaaccaguucuacacacuugcccccaugggauaa

SEQ ID NO: 8487 - RNA, 1596 nt, Artificial Sequence
  VP1__Norovirus_and/or_Norovirus-like__JN183164
augaugauggcgucuaaggacgccccaacaaacauggauggcaccaguggugccggucagcugguuccagagguuagcacagcugaaccuauaucaauggaaccuguggcuggugcugccacagcagcagcaaccgcaggucaaguuaauaugauugaccccuggauuaugaguaauuauguucaagccccucaaggagaguucacaauuuccccuaacaauacccccggagacauauuguuugauuuacaauuaggcccccauuuaaacccauuccuaucacaccuggcccagauguacaauggguggguuggcaauaugaaaguuagggugcugcucgcugguaaugcauuuacagcgggcaaaauaauaaucaguuguguccccccagguuuugcagcccagaauguuucaauagcccaagcuacuauguucccccauguuauugcagaugugcgagugcuugaaccaauugaagucccacuagaggaugugaggaaugugcuuuuccauaauaaugauucuaccccaacuaugagauugauuuguauguuguauaccccucuccgugcuagugguaguucuucuggcacugauccauuuguuauagcuggucggguccucaccugucccaguccugacuuuaacuuuuuguuccuuguccccccuaauguugaacagaaaaccaagccauuuagugugcccaaucucccccuuaauguucucucaaacucuaggguucccucucugauaaaguccaugauggucucccaagaccauggacagaugguacaauuccaaaaugguaggguuacauuagauggacagcuccaagguaccacccccacuucagcuagucagcucugcaaaauucgagggacgguuuaccaugcaacugguggucaagggcuuaauuuaacugaaauugaugggacccccuaccaugcauuugaaagcccugccccaauuggcuuccccgauuuaggugagugugauuggcacauuaacgcaucuccugcuaaugcuuucacagaugguaguauuauacauagaauugauguagcucaggauucuacuuuugccccccaucuaggcacuauccauuauacuaaugcugauuauaaugcuaauguuggccugauuuguucacuugaauggcuuuccccaccaagugguggugcuccaaagguaaauccgugggcuauuccucgguaugguucaacucugacugaggccgcccaacuggccccaccaauauacccccccgguuuuggugaggcaauuguuuucuuuaugucugauuuccccauagcuaaugguucagauggucugaguguucccugcacuauaccacaagaguuugugacccacuuuguuaaugaacaagcaccaacccguggggaagcugcccuccuucauuauguugacccugacacacaccgcaaucuaggugaguuuaaacuauacccugaaggauucaugaccuguguaccaaauucuagugguaguggcccccaaacacugcccaucaauggggucuucacuuucaucucuuggguuucccguuucuaucaacuaaagccugugggaacguaa

SEQ ID NO: 8488 - RNA, 1596 nt, Artificial Sequence
  VP1__Norovirus_and/or_Norovirus-like__AB809995
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugauuuugaauucauuuaccuagugccucccucuguagaguccaaaacuaaaccauucacacuuccaauauugaccauuucugaacuaaccaacucccgguuucccaucccaauugagcaacuguacacggccccaaaugagaauaauguuguacagugucaaaauggaaggugcaccuuggauggagagcuucagggcaccacccagcugcuaucaagugcaguuugcucuuacaggggcaggacuguggcuaacaguggggacaauugggaccagaauuugcuccagcugaccuacccaaguggugcaagcuaugaccccacugaugaaguaccagcacccuugggcacccaggauuucagugggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggagucgcucagaaugaaaacacccccuuccagcaauggguucuaccacacuacgcaggugcucucgcucuaaacaccaauuuggcacccgcuguugccccgacuuucccuggcgagcaauuacuguucuucaggucccguguuccauguguucaaggccugcgggggcaggaugcuuucauagauugucuccuaccucaagagugggugaaucacuuuuaucaagaggcugcucccucccaagcagacguugcccucaucagguaugucaacccugauacuggucgcacgcuguuugaggccaaauugcacaggucagguuuuauuacuguaucacacacuggugccuacccucuugugguccccccaaauggucauuucagguuugauucuuggguuaaccaauucuacucacucgcccccuaa

SEQ ID NO: 8489 - RNA, 1593 nt, Artificial Sequence
  VP1__Norovirus_and/or_Norovirus-like__KT732275
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccaauguaa

SEQ ID NO: 8490 - RNA, 1593 nt, Artificial Sequence
  VP1__Norovirus_and/or_Norovirus-like__AB809998
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguucacagugucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuagugccucccucuguagaguccaaaacuaaaccauucacacuuccaauauugaccauuucugaacuaaccaacucccgguuucccaucccaauugagcaacuguacacggccccaaaugagaauaauguuguacagugucaaaauggaaggugcaccuuggauggagagcuucagggcaccacccagcugcuaucaagugcaguuugcucuuacaggggcaggacuguggcuaacaguggggacaauugggaccagaauuugcuccagcugaccuacccaaguggugcaagcuaugaccccacugaugaaguaccagcaccuuugggcacccaggauuucagugggauauuguauggggugcuaacccaagacaauguaagugaggcuacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggagucgcucagaaugaaaacacccccuuccagcaauggguucuaccacacuacgcaggugcucucgcucuaaacaccaauuuggcacccgcuguugccccgacuuucccuggcgagcaauuacuguucuucaggucccguguuccauguguucaaggccugcgggggcgggaugcuuucauagauugucuccuaccucaagagugggugaaucacuuuuaucaagaggcugcucccucccaagcagacguugcccucaucagguaugucaacccugauacuggucgcacgcuguuugaggccaaauugcacaggucagguuuuauuacuguaucacacacuggugccuacccucuugugguccccccaaauggucauuucagguuugauucuuggguuaaccaauucuacucacucgccuaa

SEQ ID NO: 8491 - RNA, 1593 nt, Artificial Sequence
  VP1__Norovirus_and/or_Norovirus-like__AB809984
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuagugccucccucuguagaguccaaaacuaaaccauucacacuuccaauauugaccauuucugaacuaaccaacucccgguuucccaucccaauugagcaacuguacacggccccaaaugagaauaauguuguacagugucaaaauggaaggugcaccuuggauggagagcuucagggcaccacccagcugcuaucaagugcaguuugcucuuacaggggcaggacuguggcuaacaguggggacaauugggaccagaauuugcuccagcugaccuacccaaguggugcaagcuaugaccccacugaugaagugccagcacccuugggcacccaggauuucagugggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggagucgcucagaaugaaaacacccccuuccagcaauggguucuaccacacuacgcaggugcucucgcucuaaacaccaauuuggcacccgcuguugccccgacuuucccuggcgagcaauuacuguucuucaggucccguguuccauguguucaaggccugcgggggcaggaugcuuucauagauugucuccuaccucaagagugggugaaucacuuuuaucaagaggcugcucccucccaagcagacguugcccucaucagguaugucaacccugauacuggucgcacgcuguuugaggccaaauugcacaggucagguuuuauuacuguaucacacacuggugccuacccucuugugguccccccaaauggucauuucagguuugauucuuggguuaaccaauucuacucacucgccuaa

SEQ ID NO: 8492 - RNA, 1590 nt, Artificial Sequence
  VP1__Norovirus_and/or_Norovirus-like__KT732276
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccccauaa

SEQ ID NO: 8493 - RNA, 1590 nt, Artificial Sequence
  VP1__Norovirus_and/or_Norovirus-like__AB810009
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcucccccauuugaucguagauguuaggacauuggaaccuauuaugauacccuuaccugauguuaggaauguguucuaucauuuuaauaaucaaccccaaccuaggaugagauuaguggccaugcucuauaccccauugagaucuaaugguucaggagaugaugucuuuacugugucuuguagaguguugacuaggccaaccccugacuuugaauucauuuaccuaguuccucccucuguagaguccaaaacuaaaccauucacacuuccaauauugaccauuucugaacuaaccaacucccgguuccccaucccaauugagcaacuguacacggccccaaaugagaauaauguuguacagugucaaaauggaaggugcaccuuggauggagagcuucagggcaccacccagcuacuaucaagugcagucugcucuuacaggggcaggacuguggcuaacagaggggacaauugggaccagaauuugcuccagcugaccuacccaaguggugcaagcuaugaccccacugaugaagugccagcaccuuugggcacccaggauuucagugggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggaguugcucagaaugaaaacacccccuuccagcaauggguucuaccacacuacgcaggugcucucgcucuaaacaccaauuuggcacccgcuguugccccgacuuucccuggcgagcaauuacuguucuucaggucucguguuccauguguucaaggccugcgcgggcaggaugcuuucauagauugucuccuaccucaagagugggugaaucauuuuuaucaagaggcugcucccucccaagcagacguugcccucaucagguaugucaacccugauacuggucgcacgcuguuugaggccaaauugcauaggucagguuuuauuacuguaucacacacuggugccuacccucuugugguccccccaaauggucauuucagguuugauucuuggguuaaucaauucuacucacucuaa

SEQ ID NO: 8494 - RNA, 1590 nt, Artificial Sequence
  VP1__Norovirus_and/or_Norovirus-like__KM461690
augaagauggcgucgagugacgcugcuccaucgaaugauggugcugccaaccucguaccagaggccaacaaugagguuauggcacuugaaccgguggugggagccucaaucgcagcuccugucgucggccaacaaaacauaauugaccccuggauuagagaaaauuuuguccaagcaccacagggcgaguucaccgucucaccgaggaacucgccuggugagaugcuauuaaaucuugaauugggcccagaacucaacccuuaccuaagucaccugucccgcauguauaauggguaugcugguggcaugcagguucaggugguccuagcugggaaugcguucacagcugggaaaaucaucuuugccgccguaccaccacauuuucccguagaaaacaucagugcagcucaaauaacuaugugcccccauguaauuguugaugugagacaacuugaaccaguacuucugccccuuccugacauaaggaacagguucuuucauuacaaccaggagaacaccccccggaugagacuuguggcuaugcuuuacaccccccugagggccaacucuggugaagauguguuuacuguuucuuguagggucuugacccguccugccccugauuuugaauuuacuuucuugguaccaccaacuguugaaucaaagacuaaaccuuucacacugcccauauuaacucuuggugagcuaucuaacuccagauucccagccccaauagauauguuguacacugacccaaaugagggaauugugguccaaccacaaaaugguaggugcacucuugauggcacucugcaaggcaccacacaacugguccccacccaaauuugugcuuucaggggcacacuaauuggccaaacaucaagaucuucagacucaaccgacucagccccucggagaagggaucacccacuccaugugcaauuaaagaaccuugauggcacgcaguacgacccaacugaugaagugccagcaguccuuggugccauugacuucaaggggacugucuuugggguggccagucagagagaugugucagggcaacaagugggagcaacucgagcucaugaagugcacaucaacacaaccgauccuagguauacaccaaaacugggauccauucucaugcacucagagucggacgacuuugugacuggacagccgguccgcuucacacccauaggaaugggugacaacgacuggcaccagugggagcugccugacuacucuggacgccuaacccugaacaugaaccuugccccagcagucgcuccugcuuuuccgggcgagaggauucuuuucuucaggucaauagucccgucugcugguggcuaugggucuggacaaauagauugccucauaccacaggaguggguucagcauuucuaccaggaagcugcaccaucccaaucugccguggcacucauuagguaugucaauccugacacaggcagaaacaucuuugaggcuaaauugcacagggaagguuucaucaccguggcaaauuccgguaacaaccccauuguuguccccccuaauggguauuuuagguuugaggcuugggugaauuaa

SEQ ID NO: 8495 - RNA, 1587 nt, Artificial Sequence
  VP1__Norovirus_and/or_Norovirus-like__JN400618
augaagauggcgucgagugacgccaacccaucugauggguccacagccaaccucgucccagaggucaacaaugagguuauggcuuuggagcccguaguuggugccgccauugcggcaccuguagcgggccaacaaaauguaauugaccccuggauuagaaacaauuuuguacaagccccugguggagaguuuacaguauccccuagaaacgcuccaggugaaauacuauggagcgcgcccuuaggcccugauuugaaucccuaccuuucccauuuggccagaauguacaaugguuaugcaggugguuuugaagugcagguaauccucgcggggaacgcguucaccgccgggaaaaucauauuugcagcagucccaccaaauuucccaacugaagguuugagccccagccaggucacuauguucccccacauaauaguagauguuaggcaauuggaaccuguguugauccccuuacccgauguuaggaauaauuucuaucauuauaaucaaucaaaugacuccaccaucaaauugauagcaauguuguacacaccacuuagggcuaauaaugccggggacgaugucuucacaguuucuugucgaguucucacgagaccauccccccgauuugaaucaagaacuaaaccauucucugucccaguuuuaacuguugaggagaugaccaauucaagguuccccauuccuuuggaaaaguuguucacgggccccaguagugccuuuguuguucaaccacaaaacggcaggugcacgacugauggcgugcuccuagguaccacccaacugucuccugucaacaucugcaccuucagaggggaugucacccauauuccaggcagucguaacuacacaaugaauuuggccucccaaaauuggaacaguuacgguccaacagaagaaaucccagccccucuaggaacuccagauuucguggggaaaauucaaggugugcucacccaaaccacaaggacaaauggcucgacccgcggccacaaagcuacaguguacacugggagcgccgacuuuucuccaaaacuggguagaguucaauuugccacugacacagacaaugauuuugaaacuaaccaaaacacaaaguucaccccagucggcguuauccaggaugguaguacuaccccccgaaaugaaccccaacaaugggugcucccaaguuacucaggcaggaacauucacaaugugcaccuggcccccgcuguagcccccacuuucccgggcgagcagcuccucuuuuucagaucuacuaugcccggaugcaguggguaccccaacauggacuuggacugucugcucccccaggaaugggugcaguacuucuaccaggaggcagccccagcacaaucugauguggcucuguuaagauuugugaauccagacacagguaggguuuuguuugaguguaagcuucauaaaucaggcuauguuacaguggcucauacuggccaacaugauuugguuaucccccccaaugguuauuuuagauuugauuccugggucaaccaguucuacacacuugcccccaugggaaaugggacggggcguagacguuaa

SEQ ID NO: 8496 - RNA, 1587 nt, Artificial Sequence
  VP1__Norovirus_and/or_Norovirus-like__JQ653095
augaagauggcgucuaaugacgccgcuccaucuaaugauggugcagccggucucguaccagaggucaacaaugagaccauggcacuugaaccgguagcuggggcuucaauagccgccccacucaccggucaaaauaauguuauagaccccuggauuagauuaaacuuugugcaggcccacaauggagaguuuacaguuucaccccgcaauucgccuggggaaguccuacuaaacuuggaauuaggcccugaacuaaauccauauuuggcacaccuuuccagaauguacaaugguuaugcagguggaguugaggugcaaguacuacuggcugggaacgcguucacggcuggaaaacugguauucgccgcaguucccccucauuuuccauuagaaaacauaagcccuggccaaauaaccauguucccucauguaauuauugauguuaggacuuuagaaccaguccuauugccucuuccagauguuaggaacaauuucuuucacuacaaucagcaaaacgaaccgaggaugaggcuuguggcaaugcucuauaccccccuuagaucuaaugguucuggugaugauguauuuacugucuccuguagagugccuacucgacccucuccugauuuugauuucaauuauuugguacccccuacaguugaaucuaaaacuaaacccuucacacucccuaucuugaccauaggggaguuaaccaauuccagauucccugugcccauagaugaacucuacacuagccccaaugagaguuuggugguacaaccccagaacgggagaugcgcgcuggauggggaguugcaggguacuacucagcuccuccccacggcgaucugcucguucaggggucggauuaaucagaaagugaguggagagaaccauguuuggaauaugcaagucaccaacauuaacggaaccccuuuugacccaacagaggauguuccagcuccucuagguacaccagacuuuucuggcaagcucuuuggcguccuaagccagagggaccaugauaaugccuguaggagccaugaugcagugauugcaacuaauucugcuaaauuuaccccaaaauugggcgcuauacaaauuggcacaugggaacaagaugauguacacaucaaccaacccaccaaauuuacuccaguuggcuuguuugaaagugaggguuuuaaucaguggacacucccuaauuauucuggagccuuaacacccaacaugggguuggcccccccuguggcccccacauuuccuggcgagcaaauucuuuucuucagaucccacauuccucuuaaaggagguguggcagacccaguuauugauugucucgugccccaggaauggauccaacaccuuuaucaggagucagccccuucacaaacagauguagcacugaucagauucacaaauccagacacagggcguguccuauuugaagcaaaauugcacaggaguggcuacaucacaguggccaacacugguagcagaccaauuguggugccagcuaaugguuacuucagguuugacucuuggguuaaucaguuuuauucucucgcccccgugggaacuggauaa

SEQ ID NO: 8497 - RNA, 1587 nt, Artificial Sequence
  VP1__Norovirus_and/or_Norovirus-like__JN183161
augaugauggcgucuaaggacgcccccucaaacauggauggcacuaguggugccggucagcuggucccagagguuaaugcagcugaaccuuuaccucuugaaccgguagugggcgccgcaacugcggcugccacugcuggacaaguuaauuuaauagaccccuggauuaugaauaauuuuguucaagccccugagggugaguucaccaucucaccuaauaauaccccuggagacauuuuguucgauuugcaucuaggaccacaccuuaaucccuuucuacagcauuugucccaaauguacaaugguugggugggcaauaugagaguuagaguuaugcuugcagggaaugcguucacugcugguaagauuauaauuuguugugucccaccuggcuuugcaucccaaaauauaucaauuggucaagccacaauguucccacaugucauagcugaugugagggugcuggaaccuauagaaaucccucuugaugaugugcgcaaugucuuguuccauacuaaugagaaccgcccaaccaugcgguugcuuugcaugcuauacacaccccuccgugcugguggugcuucaucaggcacggaccccuuuguuauugcgggucgagugcuaacuugcccugccccugauuuuaauuuccuguuccucguacccccuaguguagagcagaaaaccaggcagcugacugugcccaauauaccccugaacaauauggccaauuccagagugccugcaaugauaaacaagaugacaguuuccucugaucaaaaucaggugguccaauuccagaauggucguugcacacuugaaggacagcuuuugggcacaacuccgguuucagcuagucaaguggcccgcauacguggcaaagucuucuccaccgcaucuggaaaaggacucaaucugacugaguuggauggaacuccuuaccacgcauuugagaguccagccccccucgguuucccugacaucggagcuugugauuggcaugugucaaccuuuaaaguggaucaaaaccuuucaggagauccuauguccagguuagauauaaaacaaaaugccccguuugcaccacaccuugguuccauugaauucaccucugaucaggacccaacuggggaucaauugggaacauuggcuugggucuccccuuccacuagugggaccaggguagaccccuggaaaauuccaucauaugguucaacagugacugaauccacucaucuggcaccacccauauuuccaccagguuuuggcgaggccauaguuuacuuuaugucagauuuucccauugucucaggcaacaccgcucaaguccccugcacucugccucaagaauuugucucacacuuuguagagcaacaggcaccaauucgaggugaagcugcccuacuucacuauguggacccagacacccaucguaaucugggagaguucaaacuguacccugauggauuuaucaccugugugccaaacacaggcggugguccucaaaauuuaccuacaaauggagucuuugucuuuucuuccuggguuucuagguacuaucaauuaaagccugugggaacugccuaa

SEQ ID NO: 8498 - RNA, 1587 nt, Artificial Sequence
  VP1__Norovirus_and/or_Norovirus-like__KT906670
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggcccacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucgggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccuaa

SEQ ID NO: 8499 - RNA, 1587 nt, Artificial Sequence
  VP1__Norovirus_and/or_Norovirus-like__KT906671
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaauauaauugaccccuggauuagaacaaauuuugugcaagcaccaaauggagaguucacagugucacccagaaacucuccuggagaaauuuuauuaaauuuagaguugggcccugaucugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguuuccaguccccaucgauucgcuuuucaccgcccagaauaauguguugcaggugcagugucaaaauggcagguguacacuugauggugaguuacaaggcacaacccaguugcucccaacuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauucuuggguaaaucaguuuuacucacucgccuaa

SEQ ID NO: 8500 - RNA, 1587 nt, Artificial Sequence
  VP1__Norovirus_and/or_Norovirus-like__AB810013
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcucccccauuugaucguagauguuaggacauuggaaccuauuaugauacccuuaccugauguuaggaauguguucuaucauuuuaauaaucaaccccaaccuaggaugagauuaguggccaugcucuauaccccauugagaucuaaugguucaggagaugaugucuuuacugugucuuguagaguguugacuaggccaaccccugacuuugaauucauuuaccuaguuccucccucuguagaguccaaaacuaaaccauucacacuuccaauauugaccauuucugaacuaaccaacucccgguuccccaucccaauugagcaacuguacacggccccaaaugagaauaauguuguacagugucaaaauggaaggugcaccuuggauggagagcuucagggcaccacccagcuacuaucaagugcagucugcucuuacaggggcaggacuguggcuaacagaggggacaauugggaccagaauuugcuccagcugaccuacccaaguggugcaagcuaugaccccacugaugaagugccagcaccuuugggcacccaggauuucagugggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggaguugcucagaaugaaaacacccccuuccagcaauggguucuaccacacuacgcaggugcucucgcucuaaacaccaauuuggcacccgcuguugccccgacuuucccuggcgagcaauuacuguucuucaggucucguguuccauguguucaaggccugcgcgggcaggaugcuuucauagauugucuccuaccucaagagugggugaaucacuuuuaucaagaggcugcucccucccaagcagacguugcccucaucagguaugucaacccugauacuggucgcacgcuguuugaggccaaauugcauaggucagguuuuauuacuguaucacacacuggugccuacccucuugugguccccccaaauggucauuucagguuugauucuuggguuaaucaauucuacucauaa

SEQ ID NO: 8501 - RNA, 1584 nt, Artificial Sequence
  VP1__Norovirus_and/or_Norovirus-like__EU096510
augaagauggcgucgaaugacgccaacccaucugauggguccacagccaaccucgucccagaggucaacaaugagguuauggcuuuggagcccguuguuggugccgcuauugcggcaccuguagcgggccaacaaaaugugauugaccccuggauuagaaauaauuuuguacaagccccugguggagaguuuacaguauccccuagaaacgcuccaggugaaauacuauggagcgcgcccuugggcccugaucugaaucccuaccuuucucauuuggccagaauguacaaugguuaugcagguggcuuugaagugcagguaauccuugcggggaaugcguucaccgccgggaaaaucauauuugcagcagucccaccaaauuucccaacugaaggcuugagccccagccaggucacuauguucccccauauaauaguagauguuaggcaacuggaaccuguguugauccccuuaccugauguuaggaacaauuucuaucacuacaaucaaucaaaugaccccaccauuaaauugauagcaaugcuguacacaccacuuagggcuaauaaugcuggggacgauguuuucacagucucuugucgaguucucacgaggccaucccccgauuuugauuucauauuuuuggugccacccacaguugagucaagaacuaaaccauucaccgucccaauuuuaacuguugaggaaaugaccaauucaagauuccccauuccuuuggaaaaguuguucacggguccuagcggugccuuuguuguucaaccacaaaauggcaggugcacgacugauggcgugcucuuaggcacuacccaacugucuccugucaacaucugcaccuucagaggggaugucacccacauugcaggcacucauaauuacacaaugaauuuggcuucucaaaauuggaacaauuaugacccaacagaagaaaucccagccccucuggggaccccagauuucgugggaaggauccaaggcaugcucacccaaacuacaaggggggauggcucuacccgcggccacaaagcuacagugagcacuggggauguccacuucacuccaaagcugggcaguauucaguucaacacugauacaaacaaugauuuugaaacuggccaaaacacgaaauucaccccagucgguguuguccaggaugguaaugguacccaccaaaaugaaccccaacaaugggugcucccaagcuacucagguagaacuggucauaaugcacaccuagcccccgccguagcccccacuuuuccgggugagcaacuucuuuucuucagguccacuaugcccggaugcagcggguaccccaacaugaauuuggauugucuacucccccaggaaugggugcagcacuucuaccaagaggcagcuccagcacaaucugauguggcucugcuaagauuugugaauccagacacagguaggguucuauuugagugcaagcuucauaaaucaggcuaugucacaguggcucacacuggccagcaugauuugguuaucccccccaaugguuacuuuagauuugauuccugggucaaccaauucuacacacuuuaa

SEQ ID NO: 8502 - RNA, 1584 nt, Artificial Sequence
  VP1__Norovirus_and/or_Norovirus-like__EU096513
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguaucccccagaaacgcuccaggugaaauacuauggagcgcgcccuuaggcccugaccugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccggauguuaggaauaacuucuaucacuauaaucagucaaaugauucuaccaucaaguugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuucccauuccuuuggaaaaguuguucacgggucccagcggugccuuugucguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaagcucaccaaaacacaaaauucacuccagucggugucauccaggaugguagcaccacccaccgaaaugagccccaacaaugggugcucccaaguuauucagguagaaauguccauaauguacaucuagccccugcuguagcccccacuuuuccgggugaacaacuucuuuucuucagguccacuaugcccggaugcagcggguaucccaacauggauuuggauugccuacucccccaggagugggugcagcacuucuaccaagaagcagcuccagcacaaucugauguggcucuauugagauuugugaauccagacacggguaggguccuguuugagugcaaacuucauaaaucaggcuaugucacaguggcucacaccggccagcaugauuuggucaucccucccaauggcuauuuuagguuugauuccuggguuaaucaauucuacacacuuuaa

SEQ ID NO: 8503 - RNA, 1584 nt, Artificial Sequence
  VP1__Norovirus_and/or_Norovirus-like__EU096514
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaauaauuuuguacaagccccugguggagaguucacaguguccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagccccagccagguuacuauguucccccacauaauaguagauguuaggcaauuggaaccuguguugauccccuuaccggauguuaggaauaacuucuaucauuauaaucagucaaaugauucuaccauuaaauugauagcaaugcuguauacaccacuuagggcuaauaaugcuggggaggaugucuucacagucucuugucgaguccucacgaggccauccccugauuuugacuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccccuagggacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguggcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaacauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugacuuggucaucccccccaaugguuauuuuagguuugauuccuggguuaaucaguucuacacacuuuaa

SEQ ID NO: 8504 - RNA, 1584 nt, Artificial Sequence
  VP1__Norovirus_and/or_Norovirus-like__EU096512
augaagauggcgucgaaugacgccaacccaucugauggguccgcagccaaccucgucccagaggucaacaaugagguuauggcuuuggagcccguugucggugccgcuauugcggcgccuguagcgggccaacaaaauguaauugaccccuggauuagaaacaauuuuguacaagccccugguggagaguucacaguauccccuagaaacgcuccaggugaaauacuauggagcgcgcccuuaggcccugaucugaaucccuaccuaucucauuuggccagaauguauaaugguuaugcaggugguuuugaagugcaggugauccucgcggggaacgcguucaccgccggaaaaauuauauuugcagcagucccaccaaauuuuccaacugaaggcuugagucccagccaggucacuauguucccccacauaauaguagauguuaggcaauuggaaccuguguugauccccuuaccggauguuaggaauaauuucuaucacuauaaucagucaaaugauucuaccauuaaauugauagcaaugcuguauacaccacuuagggcuaauaaugcuggggaagaugucuucacagucucuugucgaguccucacgaggccauccccugauuuugauuuuauauuuuuggugccaccuacaguugagucaagaacuaaaccauuuacugucccaaucuuaacuguugaagaaaugaccaauucaagauuccccauuccuuuggaaaaguuguucacgggucccagcggugccuuuguuguucaaccacaaaauggcagaugcacgacugauggcgugcucuuaggcaccacccaacugucuccugucaacaucugcaccuucagaggggaugucacccacauugcagguucucguaauuacacaaugaauuuggcuucucuaaauuggaacaauuaugacccaacagaagaaauuccagccccucuaggaacuccagauuucgugggaaagauccaaggugugcucacucaaaccacaaagggagauggcucgacccguggccauaaagcuacaguuuacacugggagugcccccuuuacuccaaagcugggcaguguucaauucaguacugauacagaaaaugauuuugaaacucaccaaaacacaaaauucaccccagucggugucauccaggaugguagcaccacccaccgaaaugaaccccaacaaugggugcucccaaguuauucagguagaaauguccauaauguacaccuagccccugcuguagcccccacuuuuccgggugaacaacuucuuuucuucagguccacuaugcccggaugcagcggguaucccaauauggauuuggauugccuacucccccaggagugggugcagcacuucuaccaagaggcagcuccagcacaaucugauguggcucuauugagauuugugaauccagacacggguaggguccuguuugagugcaaacuucauaaaucaggcuaugucacaguggcucacaccggccagcaugauuuggucaucccccccaauggcuauuuuagguuugauuccuggguuaaucaauucuacacacuuuaa

SEQ ID NO: 8505 - RNA, 1581 nt, Artificial Sequence
  VP1__Norovirus_and/or_Norovirus-like__KU311161
augaugauggcgucuaaggacgcccccucaaacauggauggcaccaguggugccggucagcugguuccagagguuaaugcagcugaaccucuaccccuugaaccgguggugggcgccgcaaccgcggcggccaccgcuggacagguuaauaugauagaccccuggauuaugaauaauuuuguccaagccccugaaggcgaauuuacuauuucacccaauaacaccccuggagacauuuuauuugauuugcgucugggaccacaccuuaaccccuuucuccugcauuugucccagauguauaaugguuggguugggaauaugagaguuagggucaugcuugcagggaacgcguucucugcugguaagaucauaauuuguugugucccaccuggcuuugaaucccagaacauaucaauuggacaagccacaauguucccccaugucauugcugaugugagaguccuggagcccauagaggucccccuugaugaugugcgcaauguccuguuccacacaaaugagaaucgcccaaccaugcgauugcucuguauguuauacacaccucuccgugcuggaggagcuucaucaggcacagauccuuuugucauugcuggccguguguuaacuuguccugcuccugauuucaauuuucuguuucuugugccccccaguguagaacaaaagaccaggcaauugacuauacccaauauaccccugaacaauuuggcuaacuccagagugccugcaaugauaaacaagaugacagucucugcugaucagaaucaggugguccaguuucaaaauggccguugcacacuugaaggacaacucuuagguacaaccccuguuucagccaaccaaguugcccgcauacguggcaaagucuucuccaccaacuccgggacggggcuuaauuuaacugaaguagaugggacccccuaccaugcauuugagagcccggccccccucgguuuuccugacauaggcaauugugauuggcacguguaugccuuuaagguaaaucaaaacacaggggaccccauguacagauuggauauaacacaaggaaacucauuugcaccgcaucuuggcuccauugaguuuaguucugaaaaccacccaucgggggaccaacuaggcacacuuacuuggaucuccccucucaacaaugcuucuaggguugaucccuggaaaaucccaacauaugguucaacauugacugaguccaccaacuuggcaccacccaucuuuccaccagguuuuggugagucuauaguuuauuuuaugucagauuuuccuauugugucagguaauacugcccaaaucccuugcacccugccccaagaauuuguuucauccuuuguggagcaacaggcaccgauccgaggugaagcugcucuauugcauuauguggacccagauacccaucgcaaucugggagaauucaaauuguacccugauggguucaucacuugugugccuaacacggguggcggcccccaaaaucucccaucgaauggugucuuugucuucucuucuuggguuucuagauauuaucaauuaaagccugugggaacauaa

SEQ ID NO: 8506 - RNA, 1581 nt, Artificial Sequence
  VP1__Norovirus_and/or_Norovirus-like__KX907730
augaugauggcgucuaaggacgcccccucaaacauggauggcaccaguggugccggucagcugguuccagagguuaaugcagcugaaccucuaccccuugaaccgguggugggcgccgcaacugcgguggccaccgcuggacagguuaauaugauagaccccuggauuaugaauaauuuuguccaagccccugaaggcgaauuuacuauuucacccaacaacaccccuggagauauuuuauuugauuugcgucugggaccacaccuuaaccccuuucuccugcauuugucccagauguauaauggauggguugggaauaugagaguuagggucaugcuugcagggaacgcguucucugcugguaagaucauaauuuguugugucccaccuggcuuugaaucccagaacauaucaauuggacaagccacaauguuuccccaugucauugcugaugugagaguccuggagcccauagaggucccccuugaugaugugcgcaauguccuguuccacacaaaugagaaccgcccaaccaugcgacugcucuguauguuguacacaccucuccgugcuggaggagcuucaucaggcacagacccuuuugucauugcuggccguguguuaacuugcccugcuccugauuucaauuuucuguuucuugugcccccuaguguagaacaaaagaccaggcaauugacuauacccaauauacccuugaacaauuuggcuaacuccagagugccugcaaugauaaacaagaugacagucucugcugaucagaaucaggugguccaguuucaaaauggccguugcacacuugaagggcaacucuuaggcacaaccccuguuucagccaaucaaguugcccguauacguggcaaagucuuuuccaccaacuccgggacggggcuuaauuuaacugaaguagauggaacccccuaccaugcauuugagagcccggccccucucgguuuuccugacauugguaauugugauuggcacguguaugccuuuaagguaaaucaaaacacaggggaccccauguacaggcuggacauaacacaaggaaacucauuugcgccgcaucuuggcuccauugaguuuaguucugaaaaccacccaucgggggaccaacuaggcacacuuacuuggaucuccccucuuaacaaugcuucuaggguugaucccuggaaaaucccaacauaugggucgacauugacugaguccaccaacuuggcaccacccaucuuuccaccagguuuuggugaggcuauaguuuauuuuaugucagauuuuccuauugugucagguaauacugcccaaauccccugcacccugccccaagaauuuguuucauccuuuguggagcagcaggcaccgauccgaggugaagcugcucuauugcauuauguggacccagauacccaucgcaaucugggagaauucaaauuguacccugauggguucaucacuugugugccuaacacggguggcggcccccaaaaucucccaucgaauggugucuuuguuuucucuucuuggguuucuagauauuaucaauuaaagccugugggaacauaa

SEQ ID NO: 8507 - RNA, 1581 nt, Artificial Sequence
  VP1__Norovirus_and/or_Norovirus-like__EU096507
augaagauggcgucgaaugacgccaacccaucugauggguccacagccaaccucgucccagaggucaacaaugaggucauggcuuuggagcccguuguuggugccgcuauugcggcaccuguagcgggccaacaaaauguaauugaccccuggauuagaaauaauuuuguacaagccccugguggagaguuuacaguguccccuagaaacgccccgggugagauacuauggagcgcgccuuugggcccugaucugaaccccuaccuuucccauuuggccagaauguacaauggguaugcaggugguuuugaagugcagguaauccucgcggggaacgcguucaccgccgggaaaaucauauuugcagcagucccaccaaauuuuccaacugaaggcuugagccccagccaggucacuauguucccccauauaauaguagauguuaggcaauuggaaccuguacugauccccuuaccugauguuaggaauaauuucuaucauuacaaucaaucaaaugauucuaccauuaaauugauagcuaugcuguacacaccacuuagggcuaauaaugcuggggaugaugucuucacagucucuugucgaguccucacgaggccaucccccgacuuugacuucauauucuuggugccacccacaguugaaucaagaacuaaaccauucaccgucccaaucuuaacuguugaggaaauguccaauucaagauuccccguuccuuuggaaaaguuguacacgggucccagcagugcuuuuguuguccaaccacaaaauggcaggugcacgacugauggcgugcucuuaggcaccacccagcugucugcugucaacaucugcaccuucagaggggaugucacccacauugcaggcagucaugauuacacaaugaauuuggcuucucaaaauuggaauaauuaugacccaacagaagaaaucccagccccucugggaaccccagauuucgugggaaagauccaaggcgugcucacccaaaccacaagagaggauggcucgacccgcgcccacaaagcuacagugagcacugggaguguccacuuuacuccaaagcugggcaguguucaauacaccacugacacaaacaaugauuuccaaacuggccaaaacacgaaauucaccccagucggcgucauccaggacgguaguaaccaccaaaaugaaccccaacaaugggugcucccaaacuacucagguagaacuggucauaaugugcacuuagccccugccguugcccccacuuuuccgggugagcaacuucuuuucuuuagguccaccaugcccggauguagcggguaucccaauaugaaucuggauugccuacucccccaggaaugggugcagcacuuuuaccaagaagcagcaccagcacaaucugauguggcucugcugagauuugugaauccagacacagguaggguucuguuugagugcaaacuccauaaaucaggcuaugucacaguggcucacacuggcccacaugauuugguuaucccccccaaugguuauuuuagauuugauucuuggguuaaucaguucuacacacuuuaa

SEQ ID NO: 8508 - RNA, 1581 nt, Artificial Sequence
  VP1__Norovirus_and/or_Norovirus-like__AB810007
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcucccccauuugaucguagauguuaggacauuggaaccuauuaugauacccuuaccugauguuaggaauguguucuaucauuuuaauaaucaaccccaaccuaggaugagauuaguggccaugcucuauaccccauugagaucuaaugguucaggagaugaugucuuuacugugucuuguagaguguugacuaggccaaccccugacuuugaauucauuuaccuaguuccucccucuguagaguccaaaacuaaaccauucacacuuccaauauugaccauuucugaacuaaccaacucccgguuccccaucccaauugagcaacuguacacggccccaaaugagaauaauguuguacagugucaaaauggaaggugcaccuuggauggagagcuucagggcaccacccagcuacuaucaagugcagucugcucuuacaggggcaggacuguggcuaacagaggggacaauugggaccagaauuugcuccagcugaccuacccaaguggugcaagcuaugaccccacugaugaagugccagcaccuuugggcacccaggauuucagugggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggaguugcucagaaugaaaacacccccuuccagcaauggguucuaccacacuacgcaggugcucucgcucuaaacaccaauuuggcacccgcuguugccccgacuuucccuggcgagcaauuacuguucuucaggucucguguuccauguguucaaggccugcgcgggcaggaugcuuucauagauugucuccuaccucaagagugggugaaucauuuuuaucaagaggcugcucccucccaagcagacguugcccucaucagguaugucaacccugauacuggucgcacgcuguuugaggccaaauugcauaggucagguuuuauuacuguaucacacacuggugccuacccucuugugguccccccaaauggucauuucagguuugauucuuggguuaaucaauucuaa

SEQ ID NO: 8509 - RNA, 1581 nt, Artificial Sequence
  VP1__Norovirus_and/or_Norovirus-like__AB809989
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuagugccucccucuguagaguccaaaacuaaaccauucacacuuccaauauugaccauuucugaacuaaccaacucccgguuucccaucccaauugagcaacuguacacggccccaaaugagaauaauguuguacagugucaaaauggaaggugcaccuuggauggagagcuucagggcaccacccagcugcuaucaagugcaguuugcucuuacaggggcaggacuguggcuaacaguggggacaauugggaccagaauuugcuccagcugaccuacccaaguggugcaagcuaugaccccacugaugaaguaccagcacccuugggcacccaggauuucagugggauauuguaugggguguuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggagucgcucagaaugaaaacacccccuuccagcaauggguucuaccacacuacgcaggugcucucgcucuaaacaccaauuuggcacccgcuguugccccgacuuucccuggcgagcaauuacuguucuucaggucccguguuccauguguucaaggccugcgggggcaggaugcuuucauagauugucuccuaccucaagagugggugaaucacuuuuaucaagaggcugcucccucccaagcagacguugcccucaucagguaugucaacccugauacuggucgcacgcuguuugaggccaaauugcacaggucagguuuuauuacuguaucacacacuggugccuacccucuugugguccccccaaauggucauuucagguuugauucuuggguuaaccaauucuaa

SEQ ID NO: 8510 - RNA, 1581 nt, Artificial Sequence
  VP1__Norovirus_and/or_Norovirus-like__AB810000
augaagauggcgucgaaugacgccgcuccaucgaaugauggugcagcuagucucguaccagaggccauuaaugagacuaugccauuggaacccguugcuggcgcaucuauugcugccccaguggcgggacaaacuaacauaauugaccccuggauaagaacaaauuuugugcaagccccuaauggagaguuuacaguaucaccaagaaauuccccuggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuaguccagcucaaaucacuaugcuuccccauuugauuguagauguuaggacauuggaaccuauuaugauacccuuaccugauguuaggaauguguuuuaucauuuuaauaaucaaccccaaccuaggaugagacuaguggcuaugcucuauaccccauugagaucuaaugguucaggagaugaugucuuuacugugucuuguagaguguugacuaggccaaccccugacuuugaauucauuuaccuagugccucccucuguagaguccaaaacuaaaccauucacacuuccaauauugaccauuucugaacuaaccaacucccgguuucccaucccaauugagcaacuguacacggccccaaaugagaauaauguuguacagugucaaaauggaaggugcaccuuggauggagagcuucagggcaccacccagcugcuaucaagugcaguuugcucuuacaggggcaggacuguggcuaacaguggggacaauugggaccagaauuugcuccagcugaccuacccaaguggugcaagcuaugaccccacugaugaaguaccagcacccuugggcacccaggauuucagugggauauuguaugggguguuaacccaagacaauguaagugaggguacaggggaggccaaaaaugcuaagggaguauacauauccaccaccaguggaaaauucaccccaaaaauagggucaauuggguugcauucaauaacugaaaaugugcaccccaaucaacaaucacgguucacccccguuggagucgcucagaaugaaaacacccccuuccagcaauggguucuaccacacuacgcaggugcucucgcucuaaacaccaauuuggcacccgcuguugccccgacuuucccuggcgagcaauuacuguucuucaggucccguguuccauguguucaaggccugcgggggcaggaugcuuucauagauugucuccuaccucaagagugggugaaucacuuuuaucaagaggcugcucccucccaagcagacguugcccucaucagguaugucaacccugauacuggucgcacgcuguuugaggccaaauugcacaggucagguuuuauuacuguaucacacacuggugucuacccucuugugguccccccaaauggucauuucagguuugauucuuggguuaaccaauucuaa

SEQ ID NO: 8511 - RNA, 1575 nt, Artificial Sequence
  VP1__Norovirus_and/or_Norovirus-like__AB809999
augaagauggcgucgaaugacgccgcuccaucgaaugauggugcagcuagucucguaccagaggccauuaaugagacuaugccauuggaacccguugcuggcgcaucuauugcugccccaguggcgggacaaacuaauauaauugaccccuggauaagaacaaauuuugugcaagccccuaauggagaguuuacaguaucaccaagaaauucccccggagagauucuauuaaauuuagaguuaggaccagauuugaauccuuauuuggcccaucuaucaagaauguacaauggauaugcuggagguguugaggugcaagugcuccuugcugggaacgcguucacagcaggaaagauauuauuugcagcaaucccacccaacuuuccuguagauaugauuagcccagcucaaaucacuaugcuuccccauuugauuguagauguuaggacauuggaaccuauuaugauacccuuaccugauguuaggaauguguucuaucauuuuaauaaucaaccccaaccuaggaugagauuaguggcuaugcucuauaccccauugagaucuaaugguucaggagaugaugucuuuacugugucuuguagaguguugacuaggccaaccccugacuuugaauucauuuaccuagugccucccucuguagaguccaaaacuaaaucauucacacuuccaauauugaccauuucugaacuaaccaacucccgguuucccaccccaauugagcaacuguacacggccccaaaugagaauaauguuguacagugucaaaauggaaggugcaccuuggauggagagcuucagggcaccacccagcuacuaucaagugcaguuugcucuuacaggggcaggacuguggcuaacaguggggacaauugggaccagaauuugcuccagcugaccuacccaaguggugcaagcuaugaccccacugaugaaguaccagcacccuugggcacccaggauuucagugggauauuguauggggguuuaacccaagacaauguaagugaggguacaggggaggccaaaaaugcuaagggaguauacauauccaccaccaguggaaaauucaccccaaaaauugggucaauuggauugcauucaauaacugaaaaugugcaccccaaucaacaaucacgguucacccccguuggagucgcucagaaugaaaacacccccuuccagcaauggguucuaccacacuacgcaggugcucucgcucuaaacaccaauuuggcacccgcuguugccccgacuuucccuggcgagcaauuacuguucuucaggucccguguuccauguguucaaggccugcgggggcaggaugcuuucauagauugucuccuaccucaagagugggugaaucacuuuuaucaagaggcugcucccucccaagcagacguugcccucaucagguaugucaacccugauacuggucgcacgcuguuugaggccaaauugcacaggucagguuuuauuacuguaucacacacuggugccuacccucuugugguccccccaaauggucauuucagguuugauucuuggguuaacuaa

SEQ ID NO: 8512 - RNA, 1572 nt, Artificial Sequence
  VP1__Norovirus_and/or_Norovirus-like__FJ692501
augaugauggcgucgagugacgccacucccccuucugaaggggccaccaaucugguuccagaggucaacacucagguggucccguuagagcccguugcgggugcagcugccgccgcaccuuuuacgggccaaaacaacguuauugaccccuggauauuucaaaauuuugugcaagcuccccagggagaguucaccguuuccccccgcaauacccccggugagauucuccugagaauaccauuaggccccaaucucaauccuuuucuugcacauuugucccgcauguauaaugccuggguggguggcauggaggccgagaugauauuggcugggaaugcguuuacagcuggaaaacucuugauuguggcccuccccccugguuuugaagcgacccaguugaccccggcccaagccacggccuucccucaugucaucgccgauguuaggacccuugagcccauuccaauuccauugccugacaucagaaauguucuguuccauuacaauggugaucccaccccaaccauacagauuguugucaugcuguacaccccacucaggaccaauggcaacggggaugauguguucacagugucuggccgucugcucacccgcccggcaccggauuucuccuucuccuuccugguuccacccacgguggagcagaaaacccgaccauucaccuugcccaaccuugcgguuucagaucuguccaauuccagauuuccagccccuguaaauauucugagggccgaucccaacaccacucuggcccucgauuaucagaaugggaggugcacgcuggauggcgcgcuccagggcacgacccccaccaacuccaguuuccugggguaccuaaggggcacuguggaccgggugaauuccgaucagguccacguccacuugagggagcccaacggugaccccuuccaacucgggcuuccuggcccccagggaguuccagacuaccgggccacccuugacaucuacguggacugggagaacaagaaucauggcaauccaugugagggcacccucaacacaggcucgcagacugaguacaccccugguuuaggcacccucaccuucaauaagaccucgggugacaccccugagcaaggggacccugucauaaugagauuggucgccuucagauccaaccugacagaucaacugccugccuacaauggggccuuuggucagggcgaaaaucuggcccccccgguuucuccuccagugcccggugaagucuucuugcaguuuggcucgcgcuacacgaggcucggugagcgcgagcuugcugugcagugucuccucccaagugaguggauaacacacuucuacucagaggcagccccaauccagggcgaggccaugcugcucagguaugugcaacccgaucugggcaggauccucuuugaggccaaacucuacaaggaggguuuugucaccguugcugguggaaccaacccagucaccuuuccaauugauggcacauucgucgccgucuccuggguuucccgcaacuuuguucucagccccaugggaagcggccaaggccguagaagguaa

SEQ ID NO: 8513 - RNA, 1572 nt, Artificial Sequence
  VP1__Norovirus_and/or_Norovirus-like__FJ692500
augaugauggcgucgagugacgccacucccccuucugaaggggccaccaaucugguuccagaggucaacacucagguggucccguuagagcccguugcgggugcagcugccgccgcaccuuuuacgggccaaaacaacguuauugaccccuggauauuucaaaauuuugugcaagcuccccagggagaguucaccguuuccccccgcaauacccccggugagauucuccugagaauaccauuaggccccaaucucaauccuuuucuugcacauuugucccgcauguauaaugccuggguggguggcauggaggccgagaugauauuggcugggaaugcguuuacagcuggaaaacucuugauuguggcccuccccccugguuuugaagcgacccaguugaccccggcccaagccacggccuucccucaugucaucgccgauguuaggacccuugagcccauuccaauuccauugccugacaucagaaauguucuguuccauuacaauggugaucccaccccaaccauacagauuguugucaugcuguacaccccacucaggaccaauggcaacggggaugauguguucacagugucuggccgucugcucacccgcccggcaccggauuucuccuucuccuuccugguuccacccacgguggagcagaaaacccgaucauucaccuugcccaaccuugcgguuucagaucuguccaauuccagauuuccagccccuguaaauauucugagggccgaucccaacaccacucuggcccucgauuaucagaaugggaggugcacgcuggauggcgcgcuccagggcacgacccccaccaacuccaguuuccugggguaccuaaggggcacuguggaccgggugaauuccgaucagguccacguccacuugagggagcccaacggugaccccuuccaacucgggcuuccuggcccccagggaguuccagacuaccgggccacccuugacaucuacguggacugggagaacaagaaucauggcaauccaugugagggcacccucaacacaggcucgcagacugaguacaccccugguuuaggcacccucaccuucaauaagaccucgggugacaccccugagcaaggggacccugucauaaugagauuggucgccuucagauccaaccugacagaucaacugccugccuacaauggggccuuuggucagggcgaaaaucuggcccccccgguuucuccuccagugcccggugaagucuucuugcaguuuggcucgcgcuacacgaggcucggugagcgcgagcuugcugugcagugucuccucccaagugaguggauaacacacuucuacucagaggcagccccaauccagggcgaggccaugcugcucagguaugugcaacccgaucugggcaggauccucuuugaggccaaacucuacaaggaggguuuugucaccguugcugguggaaccaacccagucaccuuuccaauugauggcacauucgucgccgucuccuggguuucccgcaacuuuguucucagccccaugggaagcggccaaggccguagaagguaa

SEQ ID NO: 8514 - RNA, 1572 nt, Artificial Sequence
  VP1__Norovirus_and/or_Norovirus-like__AB031013
augaugauggcgucuaaggacgcuacgucaagcguggauggcgccaguggcgcuggucaguugguaccggagguuaaugcuucugacccucuugcaauggauccuguggcggguucuucaacagcaguugcaacugcugggcaaguuaacccuauugacccuuggauaaucaauaacuuugugcaggcuccccaaggugaauuuacuauuucuccaaauaauacccccggugguguuuuguuugauuugagucuaggcccucaucuuaaucccuucuuguuacauuugucacaaauguauaauggcuggguuggcaacaugagaguuaggauuaugcuggcugguaaugcauuuacugcaggcaaaauuauaguuucuugcauaccuccuggcuuuggcucccauaaucuuacuauagcacaagcaacucucuucccgcaugugauugcugauguuaggacuuuagacccaauugaaguacccuuggaagauguaaggaauguucucuuucauaauaaugauagaaaucaacaaaccaugcgccuuguguguaugcuuuauaccccccuccgcacugguggcgguacaggugauucuuuugugguugcagggcgagucaugacuuguccuagccccgauuucaauuucuuguucuugguuccucccacaguggaacagaagacuaggccuuucacccucccaaauuuaccgcugaguucuuugucaaauucacgugcuccucuuccaauuaguggcauggguauuucuccagacaauguucagagugugcaguuucaaaauggccgauguaccuuagacgggcgucuuguugguaccaccccaguuucccucucccacguugcuaagauaaggggcacuucuaaugguacugugaucaaucucaccgaauuggauggcacccccuuccacccuuuugaaggcccugccccuauugguuuuccagaucuugguggcugugauuggcauauuaauaugacacaauuugggcauuccagucagacucaauaugauguagauaccacccccgacaccuucgucccucacuuagguucaauccaggcgaauggcauugguaguggcaacuauauugguguucuuagcugggucucccccccaucacauccaucuggcucucaaguugaucucuggaagauccccaacuaugggucuagcaucacagaggcaacccaucuagcucccucugucuauccuccuggcuuuggagagguguuagucuuuuucaugucaaagauaccugguccuggugcuuauagucugcccuguuuacugccacaagaauauaucucacaccucgcaagugaacaagcccccacuguuggugaggccgccuugcuccacuauguugacccugacacgggccggacucuuggggaguuuaaggcuuacccugaugguuuccuaaccugugucccuaacggggccagcucgggcccacaacaacuaccaaucaauggagucuuugucuuuguuucauggguguccagauuuuaucaguuaaagccugugggaacugccaguucggcaagauaa

SEQ ID NO: 8515 - RNA, 1572 nt, Artificial Sequence
  VP1__Norovirus_and/or_Norovirus-like__KU253442
augaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggcgguacuggugauucuucuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagacaacguccagagugugcagcuccaaaauggucggugcacucuggauggccgccugguuggcaccaccccaguuucauugucacauguugccaagauaagagggaccuccaauggcacugcaaucaaccuuacugaauuggauggcacacccuuccacccuuuugagggcccugcccccauugggcuuccagaccucgguggcugcgaucggcacaucaauaugacacaguuuggccacuccagccagacccagcaugaugcagacaccaccccugacacuuccgucccccaucuugguucaauucaggcaaauggcauuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagauaa

SEQ ID NO: 8516 - RNA, 1572 nt, Artificial Sequence
  VP1__Norovirus_and/or_Norovirus-like__EF547392
augaugauggcgucuaaggacgcuacgucaagcguggauggcgccaguggcgcuggucaguugguaccggagguuaaugcuucugacccucuugcaauggauccuguggcggguucuucaacagcaguugcaacugcugggcaaguuaacccuauugacccuuggauaaucaauaauuuugugcaggcuccccaaggcgaauuuacuauuucuccaaauaauacccccggugauguuuuguuugauuugaguuuaggcccucaucuuaaucccuucuugcuacauuugucucaaauguauaauggcuggguuggcaacaugagaguuaggauuaugcuggcugguaaugcauuuacugcagguaaaauuauaguuucuugcauaccuccuggcuuuggcucccacaaucuuacuauagcacaagcaacucuuuucccacaugugauugcugauguuaggacuuuagauccaauugaaguacccuuagaagauguaaggaauguucucuuucauaauaaugauaggaaucaacaaacaaugcgucuugugugcaugcuuuauaccccccuccgcacugguggcgguacaggugauucuuuugugguugcugggcgaguuaugacuuguccuagccccgauuucaauuucuuauuuuugguuccucccacaguagaacagaagaccaggccuuucacucucccaaauuuaccgcuaaguucuuugucaaauucacgugcuccucuuccaauuaguggcauggguauuucuccagacaauguucagagugugcaguuccaaaauggccgguguaccuuagaugggcgacuuguugguaccaccccagucucccucucccauguugcuaagauaagggguacuucuaaugguacugugaucaaucucacugaauuggauggcacccccuuccauccuuuugaaggcccugccccuauugguuucccagaucuugguggcugugauuggcauauuaacaugacacaauuuggacauucuagccagacucaguaugauguagauaccacccccgacaccuuuguuccccauuuagguucaauccaggcgaauggcguuaguaguggcaacuacauugguguucuuagcuggguaucccccccaucacauccaucuggcucccaaguugaucucuggaagauccccaacuaugggucuagcaucacagaggcgacccaucuagcucccucugucuauccuccugguuuuggagagguacuagucuuuuucaugucaaagauaccagguccuggcgcuuauagucuacccuguuuacugccacaagaauauauuucacaccuugcaagugaacaagcccccacuguuggugaggccgcccugcuccacuauguugacccugacacaggccggaaucuuggggaguuuaaggcuuaccccgaugguuuccuaaccugugucccuaauggggccagcucgggcccacaacaacugccaauuaauggagucuuugucuuuguuucauggguguccagauuuuaucaguuaaagccugugggaacugccagcacggcaagauaa

SEQ ID NO: 8517 - RNA, 1572 nt, Artificial Sequence
  VP1__Norovirus_and/or_Norovirus-like__KT943503
augaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagacaauguccagagugugcaguuccaaaauggucgguguacucuggauggccgccugguuggcaccaccccaguuucauugucacauguugccaagauaagagggaccuccaauggcacuguaaucaaccuuacugaauuggauggcacacccuuucacccuuuugagggcccugcccccauuggguuuccagaccucggugguugugauuggcauaucaauaugacacaguuuggccauucuagccagacccaguaugauguagacaccaccccugacacuuuugucccccaucuugguucaauucaggcaaauggcauuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagauaa

SEQ ID NO: 8518 - RNA, 1572 nt, Artificial Sequence
  VP1__Norovirus_and/or_Norovirus-like__AY502016
augaugauggcgucuaaggacgcuacgucaaacguggauggcgccaguggcgcuggucaguugguaccggaggcuaacacuucugacccccuugcaauggauccuguagcggguucuucaacggcagucgcgacugcugggcaaguaaaucccauugauccuuggauaauuaauaauuuugugcaagcuccccaaggggaguuuacaaucucuccaaacaauacccccggugaugucuuauuugaucugaguuuagguccccaucuuaaccccuucuugcuacaucugucacaaauguauaaugguuggguugguaacaugagaguuaggaucaugcuggccgguaaugcuuuuacugcagguaagaucauaguuuccuguauaccuccugguuuuggaucgcauaaucuuacuauagcacaaucaacucuauuuccacaugugauugcugaugucaggacucuagacccuauugaaguaccuuuggaagauguuaggaauguucuuuuucauaauaaugacaggaaucaacaaaccaugcgccuugugugcauguuguauaccccccuccguacugguggugguacaggugacuccuuugugguggcggggcgaguuaugaccugcccuagcccugauuuuaauuucuuguucuuggucccccccacaguggagcagaaaacuagaccuuucacccuuccaaauuugccuuugagcucucuguccaauucacgugcuccucuuccaauuaguagcaugggcauuuccccagauaauguccagaguguacaguuccaaaauggucgguguacuuuggacggccguuugguuggcaccaccccaguuucacugucccagguugcuaagauaagaggcacuuccaauggcacugucaucaaccucaccgaauuggauggcacaccuuuucacccuuuugagggcccugcccccauuggauucccagaucuuggugguugugacuggcaugucaacaugacacaauuuggucacucuagucagacacaauuugauguggauaccaccccugaaaccuuuguuccucauuugggaucaauccaggcaaaugguguugguaguggcaauuacauugguguucucaguuggaucucccccccaucacauccuucugguucccagguggaccucuggaagauccccaauuaugggucgagcauuacugaggcaacacacuuggccccaucaguguucccacccgguuuuggggaagugcuggucuucuuuaugucaaagauaccaggaccuggcgccuacaaucugcccugccugcugccacaagaguacaucucacauuuugcaagcgagcaagcccccacugugggcgaggcugcucugcuccauuauguugacccugauacagggcggaaccuuggggaguuuaaagcauaccccgaugguuuccucacuuguguccccaauggagcuagcucggguccacaacaauuaccaaucaaugggguuuuuguuuuugucucuugggugucuagauucuaucaauugaagccugugggaacugccagcucggcaagauaa

SEQ ID NO: 8519 - RNA, 1572 nt, Artificial Sequence
  VP1__Norovirus_and/or_Norovirus-like__KU253446
augaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagacaauguccagagugugcaguuccaaaauggucgguguacucuggauggccgccugguuggcaccaccccaguuucauugucacauguugccaagauaagagggaccuccaauggcacuguaaucaaccuuacugaauuggauggcacacccuuucacccuuuugagggcccugcccccauuggguuuccagaccucggugguugugauuggcauaucaauaugacacaguuuggccauucuagccagacccaguaugauguagacaccaccccugacacuuuugucccccaucuugguucaauucaggcaaauggcauuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucauuggggucuuugucuuuguuucauggguguccagauuuuaucaauuaaagccugugggaacugccagcucggcaagauaa

SEQ ID NO: 8520 - RNA, 1572 nt, Artificial Sequence
  VP1__Norovirus_and/or_Norovirus-like__KU253445
augaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacuugccccucucccaaucaguaguaugggcauuuccccagacaauguccagagugugcaguuccaaaauggucgguguacucuggauggccgccugguuggcaccaccccaguuucauugucacauguugccaagauaagagggaccuccaauggcacuguaaucaaccuuacugaauuggauggcacacccuuucacccuuuugagggcccugcccccauuggguuuccagaccucggugguugugauuggcauaucaauaugacacaguuuggccauucuagccagacccaguaugauguagacaccaccccugacacuuuugucccccaucuugguucaauucaggcaaauggcauuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagauaa

SEQ ID NO: 8521 - RNA, 1572 nt, Artificial Sequence
  VP1__Norovirus_and/or_Norovirus-like__KF039735
augaugauggcgucuaaggacgcuacaucaagcguggauggcgcuaguggcgcuggucaguugguaccggagguuaaugcuucugacccucuugcaauggauccuguagcagguucuucgacagcagucgcgacuacuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagacaauguccagagugugcaguuccaaaauggucgguguacucuggauggccgccugguuggcaccaccccaguuucauugucacauguugccaagauaagagggaccuccaauggcacuguaaucaaccuuacugaauuggauggcacacccuuucacccuuuugagggcccugcccccauuggguuuccagaccucggugguugugauuggcauaucaauaugacacaguuuggccauucuagccagacccaguaugauguagacaccaccccugacacuuuugucccccaucuugguucaauucaggcaaauggcauuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagauaa

SEQ ID NO: 8522 - RNA, 1572 nt, Artificial Sequence
  VP1__Norovirus_and/or_Norovirus-like__KF039732
augaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagauaauguccagagugugcaguuccaaaauggucgguguacucuggauggccgccugguuggcaccaccccaguuucauugucacauguugccaagauaagagggaccucuaauggcacuguaaucaaccuuacugaauuggauggcacacccuuucacccuuuugagggcccugcccccauuggguucccagaccucggugguugugauuggcauaucaauaugacacaguuuggccauucuagccagacccaguaugauguagacaccaccccugucacuuuugucccccaucuugguucaauucaggcaaauggcauuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagauaa

SEQ ID NO: 8523 - RNA, 1572 nt, Artificial Sequence
  VP1__Norovirus_and/or_Norovirus-like__KF039734
augaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagacaauguccagagugugcaguuccaaaauggucgguguacucuggauggccgccugguuggcaccaccccaguuucauugucacauguugccaagauaagagggaccuccaauggcacuguaaucaaccuuacugaauuggauggcacacccuuucacccuuuugagggcccugcccccauuggguuuccagaccucggugguugugauuggcauaucaauaugacacaguuuggccauucuagccagacccaguaugauguagacaccaccccugacacuuuugucccccaucuugguucaauucaggcaaauggcauuggcagugguaauuauguugguguucuuagcuggauuucccccccaucacgcccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagauaa

SEQ ID NO: 8524 - RNA, 1572 nt, Artificial Sequence
  VP1__Norovirus_and/or_Norovirus-like__KF039729
augaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagacaauguccagagugugcaguuccaaaauggucgguguacucuggauggccgccugguuggcaccaccccaguuucauugucacauguugccaagauaagagggaccuccaauggcacuguaaucaaccuuacugaauuggauggcacacccuuucacccuuuugagggcccugcccccauuggguuuccagaccucggugguugugauuggcauaucaauaugacacaguuuggccauucuagccagacccaguaugauguagacaccaccccugacacuuuugucccccaucuugguucaauucaggcaaauggcguuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagauaa

SEQ ID NO: 8525 - RNA, 1572 nt, Artificial Sequence
  VP1__Norovirus_and/or_Norovirus-like__KF039737
augaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagauaauguccagagugugcaguuccaaaauggucgguguacucuggauggccgccugguuggcaccaccccaguuucauugucacauguugccaagauaagagggaccucuaauggcacuguaaucaaccuuacugaauuggauggcacacccuuucacccuuuugagggcccugcccccauuggguucccagaccucggugguugugauuggcauaucaauaugacacaguuuggccauucuagccagacccaguaugauguaaacaccaccccugacacuuuugucccccaucuugguucaauucaggcaaauggcauuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagauaa

SEQ ID NO: 8526 - RNA, 1572 nt, Artificial Sequence
  VP1__Norovirus_and/or_Norovirus-like__KF039731
augaugauggcgucuaaggacgcuacaucaagcguggauggcgcuaguggcgcuggucaguugguaccggagguuaaugcuucugacccucuugcaauggauccuguagcagguucuucgacagcagucgcgacugcuggacaaguuaauccuauugaucccuggauaauuaauaauuuugugcaagccccccaaggugaauuuacuauuuccccaaauaauacccccggugauguuuuguuugauuugaguuuggguccccaucuuaauccuuucuugcuccaucuaucacaaauguauaaugguuggguugguaacaugagagucaggauuaugcuagcugguaaugccuuuacugcggggaagauaauaguuuccugcauacccccugguuuugguucacauaaucuuacuauagcacaagcaacucucuuuccacaugugauugcugauguuaggacucuagaccccauugaggugccuuuggaagauguuaggaauguucucuuucauaauaaugauagaaaucaacaaaccaugcgccuugugugcaugcuguacaccccccuccgcacugguggugguacuggugauucuuuuguaguugcagggcgaguuaugacuugccccaguccugauuuuaauuucuuguuuuuagucccuccuacgguggagcagaaaaccaggcccuucacacucccaaaucugccauugaguucucugucuaacucacgugccccucucccaaucaguaguaugggcauuuccccagacaauguccagagugugcaguuccaaaauggucgguguacucuggauggccgccugguuggcaccaccccaguuucauugucacauguugccaagauaagagggaccuccaauggcacuguaaucaaccuuacugaauuggauggcacacccuuucacccuuuugagggcccugcccccauuggguuuccagaccucggugguugugauuggcauaucaauaugacacaguuuggccauucuagccagacccaguaugauguagacaccaccccugacauuuuugucccccaucuugguucaauucaggcaaauggcauuggcagugguaauuauguugguguucuuagcuggauuucccccccaucacacccgucuggcucccaaguugaccuuuggaagauccccaauuaugggucaaguauuacggaggcaacacaucuagccccuucuguauaccccccugguuucggagagguauuggucuuuuucaugucaaaaaugccagguccuggugcuuauaauuugcccugucuauuaccacaagaguacauuucacaucuugcuagugaacaagccccuacuguaggugaggcugcccugcuccacuauguugacccugauaccggucggaaucuuggggaauucaaagcauacccugaugguuuccucacuuguguccccaauggggcuagcucggguccacaacagcugccgaucaauggggucuuugucuuuguuucauggguguccagauuuuaucaauuaaagccugugggaacugccagcucggcaagauaa

SEQ ID NO: 8527 - RNA, 1563 nt, Artificial Sequence
  VP1__Norovirus_and/or_Norovirus-like__KT732279
augaugauggcgucuaaggacgcuacaucaagcguggauggcgccaguggcgcuggucaguugguaccggagguuaaugcuucugacccucuugcaauggauccuguagcgggcucuucaacagcaguugcaacugcugggcaaguuaacccuauugacccuuggauaaucaauaauuuugugcaggcuccccaaggugaauuuacuauuucuccaaauaauacccccggugauguuuuguuugauuugaguuuaggcccucaucuuaaucccuucuugcuacauuugucacaaauguauaauggcuggguuggcaauaugagaguuaggauuaugcuggcugguaaugcauuuacugcagguaaaauuauaguuucuugcauaccuccuggcuuugguucccauaaccuuacuauagcacaagcaacucuuuucccacaugugauugcugauguuaggacuuuggauccaauugaaguacccuuagaagauguaaggaauguucucuuucauaauaaugauagaaaucaacaaacaaugcgccuugugugcaugcuuuauaccccccuccgcacugguggcgguacaggugacucucuugugguugcagggcgaguuaugacuugcccuagccccgauuuuaauuucuuauuuuuggucccucccacaguggaacagaagaccaggccuuuuacucucccaaauuuaccgcugaguucuuugucgaauucacgugcuccucuuccaauuaguggcauggguauuucuccagauaauguucagagugugcaguuccaaaauggccgguguaccuuggaugggcgacucguuggcaccaccccagucucccucucccauguugcuaagauaaggggcacuucuaaugguacugugaucaaucucaccgaauuggauggcacccccuuccacccuuuugaaggcccugccccuauuggcuucccagaucuugguggcugugauuggcauauuaacaugacacaauuuggacauucuagccagacucaguaugauguggauaccacccccgacaccuucgucccccauuuagguucaauccaggcgaauggcaucaauaguggcaacuacauugguguucuuagcugggucucccccccaucacacccaucuggcucucaaguugaucuuuggaagauccccaacuaugggucuaguaucacagaggcaacccaucuagcucccucugucuuuccuccugguuuuggagagguacuagucuuuuucaugucaaagauaccagguccuggugcuuauagucuacccuguuuacugccacaagaauauauuucacaccucgcaagugaacaagcccccacuguuggugaggccgccuugcuccacuauguugacccugauacaggccggaaucuuggggaguuuaaggcuuacccugaugguuuccuaaccugugucccuaauggggccagcucgggcccacaacaacugccaaucaauggagucuuugucuuuguuucaugggugucuagauuuuaucaguuaaagccugugggaacugccagcuaa

SEQ ID NO: 8528 - RNA, 1563 nt, Artificial Sequence
  VP1__Norovirus_and/or_Norovirus-like__FJ384783
augaugauggcgucuaaggacgcuacgucaagcguggauggcgccaguggcgcuggucaguugguaccggagguuaaugcuucugacccucuugcaauggauccuguagcgggcucuucaacagcaguugcaacugcugggcaaguuaacccuauugacccuuggauaaucaauaacuuugugcaggcuccccaaggcgaauuuacuauuucuccaaauaauacccccggugauguuuuguuugauuugaguuuaggcccucaucuuaaucccuucuugcuacauuugucacaaauguauaauggcuggguuggcaauaugagaguuaggauuauguuggcuggaaaugcauuuacugcagguaaaauuauaguuucuugcauaccuccuggcuuugguucccauaaccuuacuauagcacaagcaacucuuuucccacaugugauugcugauguuaggacuuuagauccaauugaaguacccuuagaagauguaaggaauguucucuuucauaauaaugacagaaaucaacaaacaaugcgccuugugugcaugcuuuacaccccccuccgcacugguggcgguacaggugauucuuuugugguugcagggcgaguuaugacuuguccuagccccgacuuuaauuucuuauuuuugguuccucccacaguggaacagaagaccaggccuuuuacucucccaaauuuaccgcugaguucuuugucaaauucacgugcuccucuuccaauuaguggcauggguauuucuccagauaauguucagagugugcaguuccaaaauggccgguguaccuuagaugggcgacuuguuggcaccaccccagucucccucucccauguugcuaagauaagggguacuucuaauggcacugugaucaaucucaccgaauuggauggcacccccuuccacccuuuugaaggcccugccccuauugguuucccagaucuugguggcugugauuggcauauuaacaugacacaauuugggcauucuagccagacucaguaugauguggacaccacccccgacaccuucgucccccacuuggguucaauccaggcgaauggcaucaauaguggcaacuacauugguguucuuagcugggucucccccccaucacacccaucuggcucucaaguugaucuuuggaagauccccaacuaugggucuagcaucacagaggcaacccaucuagcucccucugucuuuccuccugguuuuggagagguacuagucuuuuucaugucaaagauaccagguccuggugcuuauagucuacccuguuuacugccacaagaauauauuucacaccucgcaagugaacaagcccccacuguuggugaggccgcccugcuccacuauguugacccugauacaggccggaaucuuggggaguuuaaggcuuacccugaugguuuccuaaccugugucccuaauggggccagcucgggcccacaacaacugccaaucaauggagucuuugucuuuguuucauggguguccagauuuuaucaguuaaagccugugggaacugccagcuaa

SEQ ID NO: 8529 - RNA, 1563 nt, Artificial Sequence
  VP1__Norovirus_and/or_Norovirus-like__EU085522
augaugauggcgucuaaggacgcuacgucaagcguggauggcgccaguggcgcuggucaguugguaccggagguuaaugcuucugacccucuugcgauggauccuguagcgggcucuucaacagcaguugcaacugcugggcaaguuaacccuauugacccuuggauaaucaauaacuuugugcaggcuccccaaggugaauuuacuauuucuccaaauaauacccccggugauguuuuguuugauuugaguuuaggcccucaucuuaaucccuucuugcuacauuugucacaaauguauaauggcuggguuggcaauaugagaguuaggauuaugcuggcugguaaugcauuuacugcagguaaaauuauaguuucuugcauaccuccuggcuuugguucccauaaccuuacuauagcacaagcaacucuuuucccacaugugauugcugauguuaggacuuuagauccaauugaaguacccuuagaagauguaaggaauguucucuuucauaauaaugacagaaaucaacaaacaaugcgccuugugugcaugcuuuacaccccccuccgcacugguagcgguacaggugauucuuuugugguugcagggcgaguuaugacuuguccuagccccgauuuuaauuucuuauuuuugguuccucccacaguggaacagaagaccaggccuuuuacucucccaaauuuaccgcugaguucuuugucaaauucacgugcuccucuuccaauuaguggcauggguauuucuccagauaauguucagagugugcaguuccaaaauggccgguguaccuuagaugggcgacuuguuggcaccaccccagucucccucucccauguugcuaagauaagggguacuucuaauggcacugugaucaaucucaccgaauuggauggcacccccuuccacccuuuugaaggcccugccccuauugguuucccagaucuugguggcugugauuggcauauuaacaugacacaauuuggacauucuagccagacucaguaugauguggauaccacccccgacaccuucgucccccacuuagguucaauccaggcgaauggcaucaauaguggcaacuacauugguguucuuagcugggucucccccccaucacacccaucuggcucucaaguugaucuuuggaagauccccaacuaugggucuagcaucacagaggcaacccaucuagcucccucugucuuuccuccugguuuuggagagguacuagucuuuuucaugucaaagauaccagguccuggugcuuauagucuacccuguuuacugccacaagaauauauuucacaccuugcaagugaacaagcccccacuguuggugaggccgcccugcuccacuauguugacccugauacaggccggaaucuuggggaguuuaaggcuuacccugaugguuuccuaaccugugucccuaauggggccagcucgggcccacaacaacugccaaucaauggagucuuugucuuuguuucauggguguccagauuuuaucaguuaaagccugugggaacugccagcuaa

SEQ ID NO: 8530 - RNA, 1563 nt, Artificial Sequence
  VP1__Norovirus_and/or_Norovirus-like__L23828
augaugauggcgucuaaggacgcuacgucaagcguggauggcgccagugcgucgguucaguugguaccggagguuaaugcuucugacccucuugcaauggauccuguggcggguucuucaacagcaguugcaaccgcuggacaaguuaacccuauugacccuuggauaaucaauaacuuugugcaggcuccccaaggugaauuuacuauuucuccaaauaauacccccggugauguuuuguuugauuugagucuaggcccucaucuuaaucccuucuuguuacauuugucacaaauguauaauggcuggguuggcaacaugagaguuaggauuaugcuggcugguaaugcauuuacugcaggcaaaauuauaguuucuugcauaccuccuggcuuuggcucccaacaacuuacuauagcacaagcaacucucuucccgcaugugauugcugauguuaggacuuuagacccaauugaaguacccuuggaagauguaaggaauguucucuuucauaauaaugauagaaaucaacaaacuaugcgccuugugugcaugcuuuauaccccccucagcacugguggcgguacaggugauucuuuugugguugcagggcgagucaugacuuguccuagccccgacuuuaauuucuuguucuugguuccucccacaguggaacagaagacuaggccuuucacccucccaaauuuaccgcugaguucuuugucuaauucacgugcuccucuuccaauuaguggcauggguauuucuccagauaauguucagagugugcaguuccaaaauggccgauguaccuuagauggacgucuuguuggcaccaccccaguuucccucucccauguugcuaagauaagggguacuucuaaugguacaguaaucaaucucaccgaauuggauggcacccccuuccacccuuuugaaggcccugccccuauugguuuuccagaucuugguggcugugauuggcauauuaauaugacacaauuuggacauuccagucagacucaguaugauguagacaccacccccgacaccuccgucccucacuuagguucaauccaggcgaauggcauugguaguggcaacuauauugguguucuuagcugggucucccccccaucacauccaucuggcucucaaguugaucucuggaagauccccaacuaugggucuaguaucacagaggcaacccaucuagcucccucugucuauucuccuggcuuuggagaggugcuagucuuuuucaugucaaagauaccagguccugguggugauagucugcccuguuuacugccacaaggauauaucucacaccuugcaagugaacaagccccaacuguuggugaggguccccugcuccacuauguugacccugacacggaccggaaucuuggggaguuuaaggcuuacccugaugguuuccuaaccugugucccuaauggggccagcucgggcccacaacaacuaccaaucaauggagucuuugucuuuguuucauggguguccagauuuuaucaguuaaagccugugggaacugccaguuaa

SEQ ID NO: 8531 - RNA, 1563 nt, Artificial Sequence
  VP1__Norovirus_and/or_Norovirus-like__KX764843
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaguuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccgguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuucagguuugaugcuugguaa

SEQ ID NO: 8532 - RNA, 1563 nt, Artificial Sequence
  VP1__Norovirus_and/or_Norovirus-like__KX764841
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugacgucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggcgaguuacaaggcacaacccaguugcucccaucuggcaucugugcauucagaggacgggugacagcacaaauuaaccaacgugacagguggcgcaugcaacugcaaaaccucaauggcacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggaggcuauccucuuguuguuccggcuaauggacacuuuagauuugaaucuugguaa

SEQ ID NO: 8533 - RNA, 1563 nt, Artificial Sequence
  VP1__Norovirus_and/or_Norovirus-like__KX764840
augaagauggcgucgagugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugauuccugguaa

SEQ ID NO: 8534 - RNA, 1563 nt, Artificial Sequence
  VP1__Norovirus_and/or_Norovirus-like__KT864687
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccuaauggagaguucacagugucacccagaaacucucccggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgacucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuucagguuugaguccugguaa

SEQ ID NO: 8535 - RNA, 1563 nt, Artificial Sequence
  VP1__Norovirus_and/or_Norovirus-like__KX764842
augaagauggcgucgaaugacgucgcuccaucuaaugauggugcugcuggucucguaccagagggcaacaacgagacccuuccccuagaaccaguugcgggcgcagcuauagccgcacccgucacuggccaaaauaauauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugaugccugguaa

SEQ ID NO: 8536 - RNA, 1563 nt, Artificial Sequence
  VP1__Norovirus_and/or_Norovirus-like__KT864685
augaagauggcgucgagugacgccgcuccaucuaaugauggugcugcuggucucguaccagagggcaacaacgagacccuuccccuagaaccaguugcgggcgcagcuauagccgcacccgucacuggccaaaauaauauaauugaccccuggauuagaacaaauuuugugcaagcaccaaauggagaguucacagugucacccagaaacucuccuggagaaauuuuauuaaauuuagaguugggcccugaucugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgacucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucgaccagagcccaacaggcguggguuucaaccuauagcccccaauuuguccccaaauuagguccugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcccacucuggagacuauccucuuguuguuccggcuaauggacacuuuagauuugacucuugguaa

SEQ ID NO: 8537 - RNA, 1563 nt, Artificial Sequence
  VP1__Norovirus_and/or_Norovirus-like__KT864684
augaagauggcgucgagugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgacucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuauaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugagucuugguaa

SEQ ID NO: 8538 - RNA, 1563 nt, Artificial Sequence
  VP1__Norovirus_and/or_Norovirus-like__KX764836
augaagauggcgucgagugacgccgcuccaucuaaugauggugcugcuggucucguaccagagggcaacaacgagacccucccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaaccccuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuacaccccacucagaucuaauggcucaggugaugauguuuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguguuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacauuuuagguuugaagccugguaa

SEQ ID NO: 8539 - RNA, 1563 nt, Artificial Sequence
  VP1__Norovirus_and/or_Norovirus-like__KX764845
augaagauggcgucgagugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugacgucuuuacugucucuugcaggguuuugacuaggccuacuccugauuuugaguucacuuauuuagugccaccuucuguugaaucuaagacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggcgaguuacaaggcacaacccaguugcucccaucuggcaucugugcauucagaggacgggugacagcacaaauuaaccaacgugacagguggcacaugcaacugcaaaaccucaauggcacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagccuccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacauuucagguuugaagccugguaa

SEQ ID NO: 8540 - RNA, 1563 nt, Artificial Sequence
  VP1__Norovirus_and/or_Norovirus-like__KX764837
augaagauggcgucgaaugacgccgcuccaucuaaugauggugcugcuggucucguaccagagggcaacaacgagacccucccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugauguuuuuacugucucuugcaggguucugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcgcaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugugccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguguuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacauuuuagauuugacgccugguaa

SEQ ID NO: 8541 - RNA, 1563 nt, Artificial Sequence
  VP1__Norovirus_and/or_Norovirus-like__KX764838
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugagcccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccagguugucccaucuggcaucugugcauucagaggacgggugacagcacaaauuaaccaacgugacagguggcacaugcaacugcaaaaccucaauaguacaacauaugacccaacugaugaugugccagccccgcuggguacaccugacuuuaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugacgauuuccaauuccaaccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauugcuguggcucacucuggagacuauccucuuguuguuccggcuaauggacacuuuagguuugauucuugguaa

SEQ ID NO: 8542 - RNA, 1563 nt, Artificial Sequence
  VP1__Norovirus_and/or_Norovirus-like__KU687016
augaagauggcgucgaaugacgccgcuccaucuaaugauggugcugcuggucucguaccagagggcaacaacgagacccuuccccuagaaccaguugcgggcgcagcuauagccgcacccgucacuggccaaaauaauauaauugaccccuggauuagaacaaauuuugugcaagcaccaaauggagaguucacagugucacccagaaacucuccuggagaaauuuuauuaaauuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaucagccuaacagccgcaugagauuaguggcuaugcucuauaccccacucagaucuaauggcucaggugaugaugucuuuacugucucuuucaggguuuugacuaggccuacuccugauuuugaguucacuuauuuaguaccaccuucuguugaaucuagaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacaggugacagcacaaaucaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucuaucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugacgccugguaa

SEQ ID NO: 8543 - RNA, 1563 nt, Artificial Sequence
  VP1__Norovirus_and/or_Norovirus-like__KU687015
augaagauggcgucgagugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccguccugccaaauuucccaguggaauucuuaagcccagcccagaucacaaugcucccacauuuaauaguggauguuaggacucuugaaccaauuaugaucccacucccugauguuaggaauacauucuuccauuauaguaaucagccuaacagccgcaugagauuaguggcuaugcucuauaccccacucagaucuaauggcucaggugaugaugucuuuacugucucuugcaggguuuugacuaggccuacuccugauuuugaguucacuuauuuaguaccaccuucuguugaaucuaaaacuaagccuuuuuccuuaccuauuuuaacccuuucugagcucacaaauucgagguucccaguccccaucgauccgcuuuucaccgcccagaauaauguguugcaggugcagugucaaaauggcagguguacacuugauggugaguuacaaggcacaacccaauugcucccaucuggcaucugugcauucagaggacgggugacagcacaaaucaaccaacgugacagguggcacauacaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucuaucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuucagguuugaugccugguaa

SEQ ID NO: 8544 - RNA, 1563 nt, Artificial Sequence
  VP1__Norovirus_and/or_Norovirus-like__KU687013
augaagauggcgucgagugacgccgcuccaucuaaugauggugcugcuggucucguaccagagggcaacaacgagacccuuccccuagaaccaguugcgggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaucagccuaacagccgcaugagauuaguggcuaugcucuauaccccacucagaucuaauggcucagguggugaugucuuuacugucucuugcaggguuuugacuaggccuacuccugauuuugaguucacuuauuuaguaccaccuucuguuaaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaaucaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucuaucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacauuucagguuugaaucuugguaa

SEQ ID NO: 8545 - RNA, 1563 nt, Artificial Sequence
  VP1__Norovirus_and/or_Norovirus-like__KX764839
augaagauggcgucgagugacgccgcuccaucuaaugauggugcugcuggucucguaccagagggcaacaacgagacccuuccccuagaaccaguugcgggcacagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuuggaccaauuaugaucccacucccugauguuaggaauacauucuuccauuauaguaaccagccuaacagccgcaugagauuaguggcuaugcucuauaccccacucagaucuaauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggugaguuacaaggcacaacccaguugcucccaucuggcaucugugcauucagaggacgggugacagcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagauuugaggcuugguaa

SEQ ID NO: 8546 - RNA, 1563 nt, Artificial Sequence
  VP1__Norovirus_and/or_Norovirus-like__KX764844
augaagauggcgucgaaugacgccgcuccaucuaaugauggugcugcuggucucguaccagagggcaacaacgggacccuuccccuagaaccaguugcgggcgcagccauagccgcacccgucacuggccaaaauaacauaauugaccccuggauuagaauaaauuuugugcaagcaccaaauggagaguucacagugucacccagaaacucuccuggagaaauuuuauuaaacuuagaguugggcccugauuugaacccuuauuuggcucauuugucaaggauguacaauggguacgcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugggauuaguggcuaugcucuauaccccacucagaucuaauggcucaggugaugacgucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgauucgcuuuucaccgcccagaauaauguguugcaggugcagugucaaaauggcagguguacacuugauggcgaguuacaaggcacaacccaguugcucccaucuggcaucugugcauucagaggacgggugacagcacaaauuaaccaacgugacagguggcacaugcaacugcaaaaccucaauggcacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccuggugaacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuuguuguuccggcuaauggacacuuuagguuugaguccugguaa

SEQ ID NO: 8547 - RNA, 1563 nt, Artificial Sequence
  VP1__Norovirus_and/or_Norovirus-like__KT864686
augaagauggcgucgagugacgccgcuccaucuaaugauggugcugcuggucucguaccagagggcaacaacgagacccuuccccuagaaccaguugugggcgcagcuauagccgcacccgucacuggccaaaauaacauaauugaccccuggauuagaacaaauuuugugcaagcaccaaauggagaguucacagugucacccagaaacucuccuggagaaauuuuauuaaacuuagaguugggcccugauuugaacccuuauuuggcucauuugucaaggauguacaauggguaugcugguggaguggaaguucagguucuccuggcagggaacgcguucacugccggaaagauccucuucgccgccgucccgccaaauuucccaguggaauucuuaagcccagcccagaucacaaugcucccacauuuaauaguagauguuaggacucuugaaccaauuaugaucccacucccugauguuaggaauacauucuuccauuauaguaaccagccuaacagccgcaugagauuaguggcuaugcucuauaccccacucagaucugauggcucaggugaugaugucuuuacugucucuugcaggguuuugacuaggccuacuccugauuuugaguucacuuauuuagugccaccuucuguugaaucuaaaacuaagccuuuuuccuuaccuauuuuaacccuuucugagcucacaaauucgagguucccaguccccaucgacucgcuuuucaccgcccagaauaauguguugcaggugcagugucaaaauggcagguguacacuugauggugaguuacaaggcacaacccaguugcucccaucuggcaucugugcauucagaggacgggugacggcacaaauuaaccaacgugacagguggcacaugcaacugcaaaaccucaaugguacaacauaugacccaacugaugaugugccagccccgcuggguacaccugacuucaagggcgucguguuugggaugguaagccaaagaaauguggguaaugaugcgccuggcucaaccagagcccaacaggcguggguuucaaccuauagcccccaauuuguccccaaauuagguucugucaaucuuagaauuagugauaaugaugauuuccaauuccagccgacaaaauucacaccagugggcgucaaugaugacgaugauggccacccguucagacaaugggaacuaccaaacuauucaggggagcuuaccuugaauaugaaucuugcccccccaguugcuccaaauuuuccugguggacaauuguuauucuucagaucuuucgugccaugcucaggagguuacaaccaagguauuauagauugucuuauuccccaagaauggauccaacacuucuaucaggaaucagcacccucccagucagacguggcccuaaucagguaugucaaccccgauacgggacguacacuguuugaagcaaaauugcacagaucugguuacauuacuguggcucacucuggagacuauccucuugucguuccggcuaauggacauuucagauuugaguccugguaa

SEQ ID NO: 8548 - RNA, 1563 nt, Artificial Sequence
  VP1__Norovirus_and/or_Norovirus-like__KU687012
augaagauggcgucgagugacgccgcuccaucuaaugauggugcugcaggucucguaccagagaucaacacugagaccuugccccucgagcccguggccggagcggcaauugcugccccuguuacgggccaaaacaauauaauugaucccuggauuagaaacaauuuugugcaggccccuaauggugaguucacagucuccccuagaaauuccccuggugaaauuuuaaugaauuuggagcuagggccagaucuuaauccauauuuggcucaccuuucaagaauguauaaugguuaugcuggaggaguggaagugcaagugcuccuagcugggaaugcguucacagcaggaaagauccucuuugcagcaguccccccaaauuuccccguugauaugcuuaguccugcucaaauuacaaugcuuccccacuuaaccguagaugucagaacuuuggagcccauuaugaucccucugccugauguuaggaauguuuucuaucacuuuaauaaccagccugccccaagaaugagauugguugcuaugcucuacacuccuuuaagaucuaauggguccggugaugauguauucacugucuccugcagagugcuaaccagaccuacuccggacuuugaguuuacauauuugguuccccccucgguggagucuaaaaccaagccuuucacccuccccauccuaacaauuggagagcugacaaacucuagauucccagccccgaucgaucagcuguacacuucacccaacacugauauacuuguccaaccccaaaauggccgguguacacuggacggugagcuacaaggcacaacacaacuuuugacaacagcaauauguucauacaggggcacaacaucaaaccccacuagugacuacugggaugaucaccuccugcacuugguccaccccaauggggcaacauaugacccgaccgaggacgugccagcuccuuuuggcacgcaagacuuucggggcauucuguaugggguguugacccaaaauacucaaagucccagggacgaagucuccaacucccgugggaucuacaucucauccacuagugacaaguucacuccaaaacuggguacaauuggcuuacaccaagugcaaggcgacacagccagcaaccaacaaucaaaauuuacaccaguagggauagcggugaaucaaaacacuccuuucaaacagugggaacucccaaacuacucuggugcccucacccucaacacaaaccuugcaccagcgguugggcccaacuucccuggggagcaaauucuuuucuucaggucaaauguuccaaguguucaagguacccaccccacucaagagauugauugccugaucccacaggaauggauuucccauuuuuaccaagaaucagcccccucucagagugauguggcuuuggucagguaugucaacccugacacagggcgcacgaucuuugaggccaaacugcacaggcagggguuuaucaccauagcggccacuggaagcaaccccguggucgugccccccaauggguacuuuagguuugauuccugguaa

SEQ ID NO: 8549 - RNA, 1563 nt, Artificial Sequence
  VP1__Norovirus_and/or_Norovirus-like__KU687018
augaagauggcgucgaaugacgccgcuccaucuaaugauggugcugcaggucucguaccagagaucaacacugagaccuugccccucgagcccguggccggagcggcaauugcugccccuguuacgggccaaaauaauauaauugaucccuggauuagaaacaauuuugugcaggccccuaauggugaguuuacagucuccccuagaaauuccccuggugaaauuuuaaugaauuuggagcuagggccagaucuuaauccauaucuggcucaccuuucaagaauguacaaugguuaugcuagaggaguggaagugcaagugcuccuagcugggaaugcguucacggcaggaaagauccuuuuugcagcaguccccccaaauuuccccguugauaugcuuaguccugcucaaaucacaaugcuuccccauuuaauuguagauguuagaacuuuggagcccauuaugaucccucugccugauguuaggaacguuuucuaucacuuuaauaaccagccugccccaagaaugagauugguugcuaugcucuacacuccuuugagauccaauggguccggugaugauguguucacugucuccugcagggugcuaaccagaccuacuccggacuuugaguuuacauauuuaguuccccccucgguagaguccaaaaccaagccuuucacccuacccauccuaacaauuggagaguugacaaauucuagauucccagccccgaucgaucaguuguacacuucacccaacgcugauguaguuguccaaccccaaaauggccggugcacacuggacggugagcuacaaggcacaacacaacuucugacaacggcaauauguucauacaggggcacaacaucaaaccccacuagugacuacugggaugaucaccuccugcacuugguccaccccaauggggcaacauaugacccgaccgaggacgugccagcuccuuuuggcacgcaggacuuucggggcauucuguaugggguguugacucaaaacacccaaaaucccagggacgaagucuccaacucccgugggaucuacaucucauccacuagugacaaguucacuccaaaauuggguacaauuggcuuacaccaagugcaaggcgacacagccagcaaccaacaaucaaaauucacaccaguagggauagcggugaaucaaaacacuccuuucaaacagugggaacucccaaacuacucuggugcccucacccucaacacaaaccuugcaccagcgguugggcccaacuucccuggggagcaaauccuuuucuucaggucaaauguuccaaguguucaagguaaccacccuacucaagagauugauugccugaucccacaagaauggguuucccacuucuaucaagaaucagcucccucucagagugauguggcuuuggucagguaugucaauccugacacagggcgcacaaucuuugaggccaaacugcauaggcagggauuuaucaccauagcggccacuggaagcaaccccguggucgugccccccaauggguauuucagguuugaguccugguaa

SEQ ID NO: 8550 - RNA, 1563 nt, Artificial Sequence
  VP1__Norovirus_and/or_Norovirus-like__KU687021
augaagauggcgucgaaugacgccacuccaucuaaugauggugcugcaggucucguaccagagaucaacacugagaccuugccccucgagcccguggccggagcggcaauugcugccccuguuacaggccaaaauaauauaauugaucccuggauuagaaacaauuuugugcaggccccuaauggugaguuuacagucuccccuagaaauuccccuggugaaauuuuaaugaauuuggagcuagggccagaucuuaauccauaucuggcucaccuuucaagaauguacaaugguuaugcuggaggaguggaagugcaagugcuccuagcugggaaugcguucacggcaggaaagauccuuuuugcagcaguccccccaaauuuccccguugauaugcuuaguccugcucaaaucacaaugcuuccccauuuaauuguagauguuagaacuuuggagcccauuaugaucccucugccugauguuaggaacguuuucuaucacuuuaauaaccagccugccccaagaaugagauugguugcuaugcucuacacuccuuugagauccaauggguccggugaugauguguucacugucuccugcagggugcuaaccagaccuacuccggacuuugaguuuacauauuuaguuccccccucgguagaguccaaaaccaagccuuucacccuacccauccuaacaauuggagaguugacaaauucuagauucccagccccgaucgaucaguuguacacuucacccaacgcugauguaguuguccaaccccaaaauggccggugcacacuggacggugagcuacaaggcacaacacaacuucugacaacggcaauauguucauacaggggcacaacaucaaaccccacuagugacuacugggaugaucaccuccugcacuugguccaccccaauggggcaacauaugacccgaccgaggacgugccagcuccuuuuggcacgcaggacuuucggggcauucuguaugggguguugacucaaaacacccaaaaucccagggacaaagucuccaacucccgugggaucuacaucucauccacuagugacaaguucacuccaaaauuggguacaauuggcuuacaccaagugcaaggcgacacagccagcaaccaacaaucaaaauucacaccaguagggauagcggugaaucaaaacacuccuuucaaacagugggaacucccaaacuacucuggugcccucacccucaacacaaaccuugcaccagcgguugggcccaacuucccuggggagcaaauccuuuucuucaggucaaauguuccaaguguucaagguaaccacccuacucaagagauugauugccugaucccacaggaauggguuucccacuucuaucaagaaucagcucccucucagagugauguggcuuuggucagguaugucaauccugacacagggcgcacaaucuuugaggccaaacugcauaggcagggauuuaucaucauagcggccacuggaagcaaccccguggucgugccccccaauggguacuuuagauuugaauccugguaa

SEQ ID NO: 8551 - RNA, 1563 nt, Artificial Sequence
  VP1__Norovirus_and/or_Norovirus-like__KU687020
augaagauggcgucgagugacgccgcuccaucuaaugauggugcugcaggucucguaccagagaucaacacugagaccuugccccucgagcccguggccggagcggcaauugcugccccuguuacgggccaaaauaauauaauugaucccuggauuagaaacaauuuugugcaggccccuaauggugaguuuacagucuccccuagaaauuccccuggugaaauuuuaaugaauuuggagcuagggccagaucuuaauccauaucuggcucaccuuucaagaauguacaaugguuaugcuggaggaguggaagugcaagugcuccuagcugggaaugcguucacggcaggaaagauccuuuuugcagcaguccccccaaauuuccccguugauaugcuuaguccugcucaaaucacaaugcuuccccauuuaauuguagauguuagaacuuuggagcccauuaugaucccucugccugauguuaggaacguuuucuaucacuuuaauaaccagccugccccaagaaugagauugguugcuaugcucuacacuccuuugagauccaauggguccggugaugauguguucacugucuccugcagggugcuaaccagaccuacuccggacuuugaguuuacauauuuaguuccccccucgguagaguccaaaaccaagccuuucacccuacccauccuaacaauuggagaguugacaaauucuagauucccagccccgaucgaucaguuguacgcuucacccaacgcugauguaguuguccaaccccaaaauggccggugcacacuggacggugagcuacaaggcacaacacaacuucugacaacggcaauauguucauacaggggcacaacaucaaaccccacuagugacuacugggaugaucaccuccugcacuugguccaccccaauggggcaacauaugacccgaccgaggacgugccagcuccuuuuggcacgcaggacuuucggggcauucuguaugggguguugacucaaaacacccaaaaucccagggacgaagucuccaacucccgugggaucuacaucucauccacuagugacaaguucacuccaaaauuggguacaauuggcuuacaccaagugcaaggcgacacagccagcaaccaacaaucaaaauucacaccaguagggauagcggugaaucaaaacacuccuuucaaacagugggaacucccaaacuacucuggugcccucacccucaacacaaaccuugcaccagcgguugggcccaacuucccuggggagcagauccuuuucuucaggucaaauguuccaaguguucaagguaaccacccuacucaagagauugauugccugaucccacaagaauggguuucccacuucuaucaagaaucagcucccucucagagugauguggcuuuggucagguaugucaauccugacacagggcgcacaaucuuugaggccaaacugcauaggcagggauuuaucaccauagcggccacuggaagcaaccccguggucgugccccccaauggguauuucagguuugaugccugguaa

SEQ ID NO: 8552 - RNA, 1563 nt, Artificial Sequence
  VP1__Norovirus_and/or_Norovirus-like__KU687014
augaagauggcgucgaaugacgccgcuccaucuaaugauggugcugcaggucucguaccagagaucaacacugagaccuugccccucgagcccguggccggagcggcaauugcugccccuguuacgggccaaaauaauauaauugaucccuggauuagaaacaauuuugugcaggccccuaauggugaguuuacagucuccccuagaaauuccccuggugaaauuuuaaugaauuuggagcuagggccagaucuuaauccauaucuggcucaccuuucaagaauguacaaugguuaugcuggaggaguggaagugcaagugcuccuagcugggaaugcguucacggcaggaaagauccuuuuugcagcaguccccccaaauuuccccguugauaugcuuauuccugcucaaaucacaaugcuuccccauuuaauuguagauguuagaacuuuggagcccauuaugaucccucugccugauguuaggaacguuuucuaucacuuuaauaaccagccugccccaagaaugagauugguugcuaugcucuacacuccuuugagauccaauggguccggugaugauguguucacugucuccugcagggugcuaaccagaccuacuccggacuuugaguuuacauauuuaguuccccccucgguagaguccaaaaccaagccuuucacccuacccauccuaacaauuggagaguugacaaauucuagauucccagccccgaucgaccagcuguacacuucacccaacgcugauguaguuguccaaccccaaaauggccggugcacacuggacggugagcuacaaggcacaacacaacuucugacaacggcaauauguucauacaggggcacaacaucaaaccccacuagugacuacugggaugaucaccuccugcacuugguccaccccaauggggcaacauauggcccgaccgaggacgugccagcuccuuuuggcacgcaggacuuucggggcauucuguaugggguguugacucaaaauacucaaaaucccagggacgaagucuccaacucccgugggaucuacaucucauccacuagugacaaguucacuccaaaacuggguacaauuggcuuacaccaagugcaaggcgacacagccagcaaccaacaaucaaaauuuacaccaguagggauagcggugaaucaaaacacuccuuucaaacagugggaacucccaaacuacucuggugcccucacccucaacacaaaccuugcaccagcgguugggcccaacuucccuggggagcaaauucuuuucuucaggucaaauguuccaaguguucaagguacccaccccacucaagagauugauugccugaucccacaagaauggauuucccauuuuuaccaagaaucagcccccucucagagugauguggcuuuggucagguaugucaacccugacacagggcgcacgaucuuugaggccaaacugcacaggcagggguuuaucaccauagcggccacuggaagcaaccccguggucgugccccccaauggguauuucagauuugacgcuugguaa

SEQ ID NO: 8553 - RNA, 1563 nt, Artificial Sequence
  VP1__Norovirus_and/or_Norovirus-like__KU687019
augaagauggcgucgaaugacgccgcuccaucuaaugacggugcugcaggucucguaccagagaucaacacugagaccuugccccucgagcccguggccggagcggcaauugcugccccuguuacgggccaaaauaauauaauugaucccuggauuagaaacaauuuugugcaggccccuaauggugaguuuacagucuccccuagaaauuccccuggugaaauuuuaaugaauuuggagcuagggccagaucuuaauccauauuuggcucaccuaucaagaauguacaaugguuaugcuggaggaguggaagugcaagugcuccuagcugggaaugcguucacggcaggaaagauccuuuuugcagcaguccccccaaauuuccccguugauaugcuuaguccugcucaaaucacaaugcuuccccauuuaauuguagaugucagaacuuuggagcccauuaugaucccucugccugauguuaggaacguuuucuaucacuuuaauaaccagccugccccaagaaugagauugguugcuaugcucuacacuccuuuaagauccaauggguccggugaugauguauucacugucuccugcagggugcuaaccagaccuacuccggacuuugaguuuacauauuuaguuccccccucgguagaguccaaaaccaagccuuccacccuacccauccuaacaauuggagaguugacaaauucuagauucccagccccgaucgaucaguuguacacuucacccaacgcugauguaguuguccaaccccaaaauggccggugcacacuggacggugagcuacaaggcacaacacaacuuuugacaacggcaauauguucauacaggggcacaacaucaaaccccacuagugacuacugggaugaucaccuccugcacuugguccaccccaauggggcaacauaugacccgaccgaggacgugccagcuccuuuuggcacgcaggacuuucggggcauucuguaugggguguugacucaaaacacccaaaaucccagggacgaagucuccaacucccgugggaucuacaucucauccacuagugacaaguucacuccaaaauuggguacaauuggcuuacaccaagugcaaggcgacacagccagcaaccaacaaucaaaauucacaccaguagggauagcggugaaucaaaacacuccuuucaaacagugggaacucccaaacuacucuggugcccucacccucaacacagaccuugcaccagcgguugggcccaacuucccuggggagcaaauccuuuucuucaggucaaauguuccaaguguucaagguaaccacccuacucaagagauugacugccugaucccacaagaauggguuucccacuucuaucaagaaucagcucccucucagagugauguggcuuuggucagguaugucaauccugacacggggcgcacaaucuuugaggccaaacugcauaggcagggauuuaccaccauagcggccacuggaagcaaccccguggucgugccccccaauggguauuuuagauuugaauccugguaa

SEQ ID NO: 8554 - RNA, 1563 nt, Artificial Sequence
  VP1__Norovirus_and/or_Norovirus-like__KU687017
augaagauggcgucgagugacgccgcuccaucuaaugauggugcugcaggucucguaccagagaucaacacugagaccuugccccucgagcccguggccggagcggcaauugcugccccuguuacgggccaaaauaauauaauugaucccuggauuagaaacaauuuugugcaggccccuaauggugaguuuacagucuccccuagaaauuccccuggugaaauuuuaaugaauuuggagcuagggccagaucuuaauccauauuuggcucaccuuucaagaauguacaaugguuaugcuggaggaguggaagugcaagugcuccuagcugggaaugcguucacggcaggaaagauccuuuuugcagcaguccccccaaauuuccccguugauaugcuuaguccugcucaaaucacaaugcuuccccauuuaauuguagaugucagaacuuuggagcccauuaugaucccucugccugauguuaggaacguuuucuaucacuuuaauaaccagccugccccaagaaugagauugguugcugugcucuacacuccuuuaagauccaauggguccggugaugauguauucacugucuccugcagggugcuaaccagaccuacuccggacuuugaguuuacauauuuagucccccccucgguagaguccaaaaccaagccuuucacccuacccauccuaacaauuggagaguugacaaauucuagauucccagccccgaucgaucaguuguacacuucacccaacgcugauguaguuguccaaccccagaauggccggugcacacuggacggugagcuacaaggcacaacacaacuucugacaacggcaauauguucauacaggggcacaacaucaaaccccacuagugacuacugggaugaucaccuccugcacuugguccaccccaauggggcaacauaugacccgaccgaggacgugccagcuccuuuuggcacgcaggacuuucggggcauucuguaugggguguugacucaagacacccaaaaucccagggacgaagucuccaacucccgugggaucuacaucucauccacuagugacaaguucacuccaaaauuggguacaauuggcuuacaccaagugcaaggcgacacagccagcaaccaacaaucaaaauucacaccaguagggauagcggugaaucaaaacacuccuuucaaacagugggaacucccaaacuacucuggugcccucacccucaacacaaaccuugcaccagcgguugggcccaacuucccuggggagcaaauccuuuucuucaggucaaauguuccaaguguucaagguaaccacccuacucaagagauugacugccugaucccacaagaauggguuucccacuucuaucaagaaucagcucccucucagagugauguggcuuuggucagguaugucaauccugacgcggggcgcacaaucuuugaggccaaacugcauaggcagggauuuaucaccauagcggccacuggaagcaaccccguggucgugccccccaauggguauuuuagguuugaagccugguaa

SEQ ID NO: 8555 - RNA, 1563 nt, Artificial Sequence
  VP1__Norovirus_and/or_Norovirus-like__KU687024
augaagauggcgucgagugacgccgcuccaucuaaugauggugcugcaggucucguaccagagaucaacacugagaccuugccccucgagcccguggccggagcggcaauugcugccccuguuacgggccaaaacaauauaauugaucccuggauuagaaacaauuuugugcaggccccuaauggugaguccacagucuccccuagaaauuccccuggugaaauuuuaaugaauuuggagcuagggccagaucuuaauccauauuuggcucaccuuucaagaauguauaaugguuaugcuggaggaguggaagugcaagugcuccuagcugggaaugcguucacagcaggaaagauccucuuugcagcaguccccccaaauuuccccguugauaugcuuaguccugcucaaauuacaaugcuuccccacuuaaucguagaugucagaacuuuggagcccauuaugaucccucugccugauguuaggaauguuuucuaucacuuuaauaaccagccugccccaagaaugagauugguugcuaugcucuacacuccuuuaagauccaauggggccggugaugauguauucacugucuccugcagagugcuaaccagaccuacuccggacuuugaguuuacauauuugguuccccccucgguggagucuaaaaccaagccuuucacccuccccauccuaacaauuggagagcugacaaacucuagauucccagccccgaucgaucagcuguacacuucacccaacacugauauacuuguccaaccccaaaauggccgguguacacuggacggugagcuacaaggcacaacacaacuuuugacaacagcaauauguucauacaggggcacaacaucaaaccccacuagugacuacugggaugaucaccuccugcacuugguccaccccaauggggcaacauaugacccgaccgaggacgugccagcuccuuuuggcacgcaagacuuucggggcauucuguaugggguguugacucaaaauacucaaaaucccagggacgaagucuccaacucccgugggaucuacaucucauccacuagugacaaguucacuccaaaacuggguacaauuggcuuacaccaagugcaaggcgacacagccagcaaccaacaaucaaaauuuacaccaguagggauagcggugaaucaaaacacuccuuucaaacagugggaacucccaaacuacucuggugcccucacccucaacacaaaccuugcaccagcgguugggcccaacuucccuggggagcaaauucuuuucuucaggucaaauguuccaaguguucaagguacccaccccacucaagagauugauugccugaucccacaagaauggauuucccauuuuuaccaagaaucagcccccucucagagugauguggcuuuggucagguaugucaacccugacacagggcgcacgaucuuugaggccaaacugcacaggcagggguuuaucaccauagcggccacuggaagcaaccccguggucgugccccccaauggguacuucagauuugaggccugguaa

SEQ ID NO: 8556 - RNA, 1563 nt, Artificial Sequence
  VP1__Norovirus_and/or_Norovirus-like__KU687022
augaagauggcgucgaaugacgccgcuccaucuaaugauggugcugcaggucucguaccagagaucaacacugagaccuugccccucgagcccguggccggagcggcaauugcugccccuguuacgggccaaaauaauauaauugaucccuggauuagaaacaauuuugugcaggccccuaauggugaguuuacagucuccccuagaaauuccccuggugaaauuuuaaugaauuuggagcuagggccagaucuuaauccauauuuggcucacccuucaagaauguacaaugguuaugcuggaggaguggaagugcaagugcuccuagcugggaaugcguucacggcaggaaagauccuuuuugcagcaguccccccaaauuuccccguugauaugcuuaguccuacucaaauuacaaugcuuccccauuuaacuguagaugucagaacuuuggagcccauuaugaucccucugccugauguuaggaacguuuucuaucacuuuaauaaccagccugccccaagaaugagauugguugcuaugcucuacacuccuuuaagauccaauggguccggugaugauguacucacugucuccugcagggugcuaaccagaccuacuccggacuuugaguuuacauauuuaguuccccccucgguagaguccaaaaccaagccuuucacccuacccauccuaacaauuggagaguugacaaauucuagauucccagccccgaucgaucaguuguacacuucacccaacgcugauguaguuguccaaccccaaaauggccggugcacacuggacggugagcuacaaggcacaacacaacuucugacaacggcaauauguucauacaggggcacaacaucaaaccccacuagugacuacugggaugaucaccuccugcacuugguccaccccaauggggcaacauaugacccgaccgaggacgugccagcuccuuuuggcacgcaggacuuucggggcauucuguaugggguguugacucaaaacacccaaaaucccagggacgaagucuccaacucccgugggaucuacaucucauccacuagugacaaguucacuccaaaauuggguacaauuggcuuacaccaagugcaaggcgacacagccagcaaccaacaaucaaaauucacaccaguagggauagcggugaaucaaaacacuccuuucaaacagugggaacucccaaacuacucuggugcccucacccucaacacaaaccuugcaccagcgguugggcccaacuucccuggggagcaaauccuuuucuucaggucaaauguuccaaguguucaagguaaccacccuacucaagagauugauugccugaucccacaagaauggguuucccacuucuaucaagaaucagcucccucucagagugauguggcuuuggucagguaugucaauccugacacagggcgcacaaucuuugaggccaaacugcauaggcagggauuuaucaccauagcggccacuggaagcaaccccguggucgugccccccaauggguacuuuagguuugagucuugguaa

SEQ ID NO: 8557 - RNA, 1563 nt, Artificial Sequence
  VP1__Norovirus_and/or_Norovirus-like__KU687023
augaagauggcgucgagugacgccgcuccaucuaaugauggugcugcaggucucguaccagagaucaacacugagaccuugccccucgagcccguggccggagcggcaauugcugccccuguuacgggccaaaacaauauaauugaucccuggauuagaaacaauuuugugcaggccccuaauggugaguucacagucuccccuagaaauuccccuggugaaauuuuaaugaauuuggagcuagggccagaucuuaauccauauuuggcucaccuuucaagaauguauaaugguuaugcuggaggaguggaagugcaagugcuccuagcugggaaugcguucacagcaggaaagauccucuuugcagcaguccccccaaauuuccccguugauaugcuuaguccugcucaaauuacaaugcuuccccacuuaaucguagaugucagaacuuuggagcccauuaugaucccucugccugauguuaggaauguuuucuaucacuuuaauaaccagccugccccaagaaugagauugguugcuaugcucuacacuccuuuaagauccaauggguccggugaugauguauucacugucuccugcagagugcuaaccagaccuacuccggacuuugaguuuacauauuugguuccccccucgguggagucuaaaaccaagccuuucacccuccccauccuaacaauuggagagcugacaaacucuagauucccagccccgaucgaucagcuguacacuucacccaacacugauauacuuguccaaccccaaaauggccgguguacacuggacggugagcuacaaggcacaacacaacuuuugacaacagcaauauguucauacaggggcacaacaucaaaccccacuagugacuacugggauggucaccuccugcacuugguccaccccaauggggcaacauaugacccgaccgaggacgugccagcuccuuuuggcacgcaagacuuucggggcauucuguaugggguguugacucaaaauacucaaaaucccagagacgaagucuccaacucccgugggaucuacaucucauccacuagugacaaguucacuccaaaacuggguacaauuggcuuacaccaagugcaaggcgacacagccagcaaccaacaaucaaaauuuacaccaguagggauagcggugaaucaaaacacuccuuucaaacagugggaacucccaaacuacucuggugcccucacccucaacacaaaccuugcaccagcgguugggcccaacuucccuggggagcaaauucuuuucuucaggucaaauguuccaaguguucaagguacccaccccacucaagagauugauugccugaucccacaagaauggauuucccauuuuuaccaagaaucagcccccucucagagugauguggcuuuggucagguaugucaacccugacacagggcgcacgaucuuugaggccaaacugcacaggcagggguuuaucgccauagcggccacuggaagcaaccccguggucgugccccccaauggguacuucagauuugaagccugguaa

SEQ ID NO: 8558 - RNA, 1563 nt, Artificial Sequence
  VP1__Norovirus_and/or_Norovirus-like__KX764847
augaagauggcgucgaaugacgccaacccaucugauggguccgcagccaaccucgucccagaggucaacaaugagguuauggcuuuggagcccguuguaggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcaggugauucucgcggggaacgcguucaccgccgggaaggucauauuugcagcagucccaccaaauuuuccaacugaagguuugagccccagccaggucacuauguuuccccauauaguaguagauguuaggcaacuagaaccuguguugauucccuuacccgauguuaggaauaauuucuaucauuacaaucaaucaaaugaccccaccauuaaauugauagcaauguuguacacaccacuuagggcuaauaaugcuggggaugaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguaguaguaacuacacaaugaauuuggcuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguacacugggagcgccgauuuugcuccaaaacuggguagaguucaauuugaaacugacacagaccaugauuuugaagccaaccaaaacacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucuacuuccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaauggcuauuucagauuugaggccugguaa

SEQ ID NO: 8559 - RNA, 1563 nt, Artificial Sequence
  VP1__Norovirus_and/or_Norovirus-like__KX764846
augaagauggcgucgaaugacgccaacccaucugauggguccgcagccaaccucgucccagaggucaacaaugagguuauggcuuuggagcccguuguaggugccgccauugcggcaccuguagcgggccaacaaaauguaauugaccccuggauuagaaauaauuuuguacaagccccugguggagaguucacaguauccccuagaaacgcuccaggugaaauacuauggagcgcgcccuugggcccugaucuaaaucccuaccuaucccauuuggccagaauguacaaugguuaugcaggugguuuugaagugcaggugauucucgcggggaacgcguucaccgccgggaaggucauauuugcagcagucccaccaaauuuuccaacugaagguuugagccccagccaggucacuauguuuccccauauaguaguagauguuaggcaacuagaaccuguguugauucccuuacccgauguuaggaauaauuucuaucauuacaaucaaucaaaugacccccccauuaaauugauagcaauguuguacacaccacuuagggcuaauaaugcuggggaugaugucuucacaguuucuugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccacccaacugucuccugucaacaucugcaccuucagaggagaugucacccauaucacagguagucguaacuacacaaugaauuuggcuucucaaaauuggagcaauuaugacccaacagaagaaaucccagccccucuaggaacuccagauuuuguggggaagauucaaggcaugcucacccaaaccacaaggacagauggcucaacacgcggccacaaagccacaguguacacugggagcgccgauuuugcuccaaaacuggguagaguucaauuugaaacugacacagaccaugauuuugaagccaaccaaaacacaaaguucaccccaguuggugucauccaagaugguagcaccacccaccgaaaugaaccccaacagugggugcucccaaguuacucaggcagaaauacuccuaaugugcaucuggccccugcuguagcccccacuuuuccgggugagcaacuucucuucuucagauccaccaugcccggaugcagcggguaccccaacauggauuuggacugucuacuuccccaggaaugggugcaguacuucuaccaagaggcagccccagcacaaucugauguggcucugcuaagauuugugaauccagacacagguaggguuuuguuugaguguaagcuucauaaaucaggcuauguuacaguggcucacacuggccaacaugauuugguuaucccccccaauggcuacuuuagguuugacgccugguaa

SEQ ID NO: 8560 - RNA, 1563 nt, Artificial Sequence
  VP1__Norovirus_and/or_Norovirus-like__KX764833
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaauaauuuuguacaagccccugguggggaguuuacaguauccccuagaaacgcuccaggugaaauacuauggagcgcgccccuaggcccugaccuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaaguccuagccaggucacuauguucccucauauaauaguggauguuagacaauuagaaccugugcugauucccuuacccgaugucaggaauaauuucuaccauuacaaucagucaaaugauuccacuauuaaguugauagcaauguuguacacaccacuuagggcuaauaaugcuggggaugauguuuucacaguuucgugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacaacugauggcgugcuucuaggcaccacccaacugucuccugucaacaucugcaccuucagaggggaugucacccacaucacagguagucgcaacuacacaaugaauuuggcuucucaaaauuggaacaacuaugacccaacagaagaaaucccagcaccucuaggaacuccagauuuuguggggaagauccaaggcaugcucacccaaaccacaaggacagaugguucaacacgcggccacagagcuacaguguacacugggagcgccgacuuugcuccaaaacuggguagaguucaauuugaaacugacacagaccaugauuuugaagcuaaucaaaacacaaaguucaccccagucggugucauccaagaugguagcaccacccaccgaaaugaaccccaacagugggugcucccaaguuacucaggcagaaauacucacaaugugcaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaagcuucacaaaucaggguauguuacaguggcucacacuggccaacaugauuugguuaucccccccaaugguuauuucagguuugacgcuugguaa

SEQ ID NO: 8561 - RNA, 1563 nt, Artificial Sequence
  VP1__Norovirus_and/or_Norovirus-like__KX764834
augaagauggcgucgagugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaauaauuuuguacaagccccugguggggaguuuacaguauccccuagaaacgcuccaggugaaauacuauggagcgcgccccuaggcccugaccuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaaguccuagccaggucacuauguucccucauauaauaguggauguuagacaauuagaaccugugcugauucccuuacccgaugucaggaauaauuucuaucauuacaaucagucaaaugauuccacuauuaaguugauagcaauguuguauacaccacuuagggcuaauaaugcuggggaugauguuuucacaguuucgugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucagccacaaaacggcaggugcacaacugauggcgugcuucuagacaccacccaacugucuccugucaacaucugcaccuucaggggggaugucacccacaucacagguagucgcaacuacacaaugaauuuggcuucucaaaauuggaacaacuaugacccaacagaagaaaucccagcaccucuaggaacuccagauuuuguggggaagauccaaggcaugcucacccaaaccacaaggacagaugguucaacacgcggccacaaggcuacaguguacacugggagcgccgacuuugcuccaaaacuggguagaguucaauuugaaacugacacagaccaugauuuugaagcuaaucaaaacacaaaguucaccccagucggugucauccaagaugguagcaccacccaccgaaacgaaccccaacagugggugcucccaaguuacucaggcagaaauacucacaauguacaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaagcuucacaaaucaggcuauguuacaguggcucacacuggccaacaugauuugguuaucccccccaaugguuacuucagguuugacucuugguaa

SEQ ID NO: 8562 - RNA, 1563 nt, Artificial Sequence
  VP1__Norovirus_and/or_Norovirus-like__KU687027
augaagauggcgucgaaugacgccaacccaucugauggguccgcagccaaccucgucccagaggucaacaaugagguuauggcucuggagcccguuguuggugccgccauugcggcacuuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccaggauguacaaugguuaugcagguggcuuugaagugcagguaauucucgcggggaaugcguucaccgccgggaaggucauauuugcagcagucccaccaaauuuuccaacugaaggcuugagccccagucaggucacuauguucccccauauaguaguagauguuaggcaacuagaaccuguguugauucccuuacccgauguuaggaauaauuucuaucauuacaaucaaucaaaugacccuaccauuaaauugauagcaauguuguauacaccacuuagggcuaauaaugcuggggaagaugucuucacaguuucuugcagaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccauccaacugucuccugucaacaucugcaccuucagaggagaugucacccauaucacagguagucguaacuacacaaugaauuuggcuucucaaaauuggaacgauuaugacccaacagaagaaaucccagccccucuaggaacuccagauuuuguggggaagauucaaggcaugcucacccaaaccacaaggacagauggcucaacacgcggccacaaagcuacaguguauacugggagcgccgacuuugcuccaaaacuggguagaguucaauuugaaacugacacagaccaugauuuugaagcuaaccaaaacacaaaguucaccccaguuggugucauccaagaugguagcaccacccaccgaaacgaaccccaacagugggugcucccaaguuacucaggcagaaauacuccuaaugugcauuuggcccccgcuguggcccccacuuuuccgggugagcaacuucucuucuucagauccaccacgcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuacuucagguuugagucuugguaa

SEQ ID NO: 8563 - RNA, 1563 nt, Artificial Sequence
  VP1__Norovirus_and/or_Norovirus-like__KX764835
augaagauggcgucgaaugacgccaacccaucugauggguccgcagccaaccucguaccagaggucaacaaugagguuauggcuuuggagcccguuguuggugccgcuauugcggcaccuguagcgggccaacaaaauguaauugaccccuggauuagaaacaauuuuguacaagccccugguggggaguuuacaguauccccuagaaacgcuccaggugagauacuauggagcgcgccccuaggcccugaccuaaaucccuaccuaucccauuuggccagaauguacaauggcuaugcaggugguuuugaagugcagguaauucucgcggggaacgcguucaccgccgggaagaucauauuugcagcagucccaccaaauuuuccaacugaaggcuuaaguccuagccaggucacuauguucccccauauaauaguggauguuagacaauuagaaccugugcugauucccuuacccgaugucaggaauaauuucuaucauuacaaucagucaaaugauuccacuauuaaguugauagcaauguuguauacaccaccuagggcuaauaaugcuggggaugauguuuucacaguuucgugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacaacugauggcgugcuucuaggcaccacccaacugucuccugucaacaucugcaccuucagaggggaugucacccacaucacagguagucgcaacuacacaaugaauuuggcuucucaaaauuggaacaacuaugacccaacagaagaaaucccagccccucuaggaacuccagauuuuguggggaagauccaaggcaugcucacccaaaccacaaggacagaugguucaacacgcggccacaaagcuacaguguacacugggagcgccgacuuugcuccaaaacuggguagaguucaauuugaaacugacacagaccaugauuuugaagcuaaucaaaacacaaaguucaccccagucggugucauccaagaugguagcaccacccaccgaaacgaaccccaacagugggugcucccaaguuacucaggcagaaacacucacaauguacaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaaguuucacaaaucaggcuauguuacaguggcucacacuggccaacaugauuugguuaucccccccaauggguacuucagguuugaauccugguaa

SEQ ID NO: 8564 - RNA, 1563 nt, Artificial Sequence
  VP1__Norovirus_and/or_Norovirus-like__KX764832
augaagauggcgucgaaugacgucaacccaucugauggguccgcagccaaccucguaccagaggucaacaaugagguuauggcuuuggagcccguuguuggugccgcuauugcggcaccuguagcgggccaacaaaauguaauugaccccuggauuagaaauaauuuuguacaagccccugguggggaguuuacaguauccccuagaaacgcuccaggugaaauacuauggagcgcgccccuaggcccugaccuaaaucccuaccuaucccauuuggccagaauguacaaugguuaugcaggugguuuugaagugcagguaauucucgcggggaacgcguucaccgccgggaagaucauauuugcagcagucccaccaaauuuuccaacugaaggcuuaaguccuagccaggucacuauguucccccauauaauaguggauguuagacaauuagaaccugugcugauucccuuacccgaugucaggaauaauuucuaucauuacaaucagucaaaugauuccacuauuaaguugauagcaauguuguauacaccacuuagggcuaauaaugcuggggaugauguuuucacaguuucgugccgaguucucacgagaccaucccccgauuuugauuucauauuuuuagugccacccacaguugagucaagaacuaaaccauucucugucccaguuuuaacuguugaggagaugaccaauucaagauuccccauuccuuuggaaaaguuguucacgggccccagcagugccuuuguuguucaaccacaaaacggcaggugcacaacugauggcgugcuucuaggcaccacccaacugucuccugucaacaucugcaccuucaggggggaugucacccacaucacagguagucgcaacuacacaaugaauuuggcuucucaaaauuggaacaacuaugacccaacagaagaaaucccagcaccucuaggaacuccagauuuuguggggaagauccaaggcaugcucacccaaaccacaaggacagaugguucaacacgcggccacaaagcuacaguguacacugggagcgccgacuuugcuccaaaacuggguagaguucaauuugaaacugacacggaccaugauuuugaagcuaaucaaaacacaaaguucaccccagucggugucauccaagaugguagcaccacccaccgaaacgaaccccaacagugggcgcucccaaguuacucaggcagaaauacucacaauguacaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccaaacacagguaggguuuuguuugagugcaagcuucacaaaucaggccauguuacaguggcucacacuggccaacaugauuugguuaucccccccaaugguuacuuuagauuugacucuugguaa

SEQ ID NO: 8565 - RNA, 1563 nt, Artificial Sequence
  VP1__Norovirus_and/or_Norovirus-like__KU687025
augaagauggcgucgaaugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccaggauguacaaugguuaugcagguggcuuugaagugcagguaguucucgcggggaaugcguucaccgccgggaaggucauauuugcagcagucccaccaaauuuuccaacugaagacuugagccccagucaggucacuauguucccccauauaguaguagauguuaggcaacuagaaccuguguugauucccuuacccgauguuaggaauaauuucuaucauuacaaucaaucaaaugacccuaccauuaaauugauagcaauguuguauacaccacuuagggcuaauaaugcuggggaagaugucuucacaguuucuugcagaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccauccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagauggcucaacacgcggccacaaagcuacaguguauacugggagcgccgacuuugcuccaaaacuggguagagcucaauuugaaacugacacagaccaugauuuugaagcuaaccaaaacacaaaguucaccccaguuggugucauccaagaugguagcaccacccaccgaaacgaaccccaacagugggugcucccaaguuacucaggcagaaauacuccuaaugugcauuuggcccccgcuguggcccccacuuuuccgggugagcaacuucucuucuucagauccaccacgcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacgcuggccaacaugauuugguuaucccccccaaugguuauuucagguuugaagccugguaa

SEQ ID NO: 8566 - RNA, 1563 nt, Artificial Sequence
  VP1__Norovirus_and/or_Norovirus-like__KU687026
augaagauggcgucgagugacgccaacccaucugauggguccgcagccaaccucgucccagaggucaacaaugagguuauggcucuggagcccguuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccaggauguacaaugguuaugcagguggcuuugaagugcagguaauucucgcggggaaugcguucaccgccgggaaggucauauuugcagcagucccaccaaauuuuccaacugaaggcuugagccccagucaggucacuauguucccccauauaguaguagauguuaggcaacuagaaccuguguugauucccuuacccgauguuaggaauaauuucuaucauuacaaucaaucaaaugacccuaccauuaaauugauagcaauguuguauacgccacuuagggcuaauaaugcuggggaagaugucuucacaguuucuugcaaaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccauccaacugucuccugucaacaucugcaccuucagaggagaugucacccauaucacagguagucguaacuacacaaugaauuuggcuucucaaaauuggaacaauugugacccaacagaagaaaucccagccccucuaggaacuccagauuuuguggggaagauucaaggcaugcucacccaaaccacaaggacagauggcucaacacgcggccacaaagcuacaguguauacugggagcgccgacuuugcuccaaaacuggguagaguucaauuugaaacugacacagaccaugauuuugaagcuaaccaaaacacaaaguucaccccaguuggugucauccaagaugguagcaccacccaccgaaacgaaccccaacagugggugcucccaaguuacucaggcagaaauacuccuaaugugcauuuggcccccgcuguggcccccacuuuuccgggugagcaacuucucuucuucagauccaccacgcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaacgguuauuucagguuugacgccugguaa

SEQ ID NO: 8567 - RNA, 1563 nt, Artificial Sequence
  VP1__Norovirus_and/or_Norovirus-like__KU687028
augaagauggcgucgaaugacgccaacccaucugauggguccgcagccaaccucgucccagaggucaacaaugagguuauggcucuggagcccgcuguuggugccgccauugcggcaccuguagcgggccaacaaaauguaauugaccccuggauuagaaauaauuuuguacaagccccugguggagaguuuacaguauccccuagaaacgcuccaggugaaauacuauggagcgcgcccuugggcccugaucuaaaucccuaccuaucccauuuggccaggauguacaaugguuaugcagguggcuuugaagugcagguaauucucgcggggaaugcguucgccgccgggaaggucauauuugcagcagucccaccaaauuuuccaacugaaggcuugagccccagucaggucacuauguucccccauauaguaguagauguuaggcaacuagaaccuguguugauucccuuacccgauguuaggaauaauuucuaucauuacaaucaaucaaaugacccuaccauuaaauugauagcaauguuguauacaccacuuagggcuaauaaugcuggggaagaugucuucacaguuucuugcagaguucucacgagaccaucccccgauuuugauuucauauuucuagugccacccacaguugagucaagaacuaaaccauucucugucccaguuuuaacuguugaggagaugaccaauucaagauuccccauuccuuuggaaaaguuguucacgggucccagcagugccuuuguuguccaaccacaaaacgguaggugcacgacugauggcgugcuccuaggcaccauccaacugucuccugucaacaucugcaccuucagaggagaugucacccauaucacagguagucguaacuacacaaugaauuuggcuucucaaaauuggaacaauuaugacccaacagaagaaaucccagccccucuaggaacuccagauuuuguggggaagauucaaggcaugcucacccaaaccacaaggacagauggcucaacacgcggccacaaagcuacaguguauacugggagcgccgacuuugcuccaaaacuggguagaguucaauuugaaacugacacagaccaugauuuugaagcuaaccaaaacacaaaguucaccccaguuggugucauccaagaugguagcaccacccaccgaaacgaaccccaacagugggugcucccaaguuacucaggcagaaauacuccuaaugugcauuuggcccccgcugugccccccacuuuuccgggugagcaacuucucuucuucagauccaccacgcccggaugcagcggguaccccaacauggauuuggacugucugcucccccaggaaugggugcaguacuucuaccaagaggcagccccagcacaaucugauguggcucugcuaagauuugugaacccagacacagguaggguuuuguuugaguguaagcuucauaaaucaggcuauguuacaguggcucacacuggccaacaugauuugguuaucccccccaaugguuacuuuagguuugaaucuugguaa

SEQ ID NO: 8568 - RNA, 1563 nt, Artificial Sequence
  VP1__Norovirus_and/or_Norovirus-like__KX764831
augaagauggcgucgagugacgucaacccaucugauggguccgcagccaaccucguaccagaggucaacaaugagguuauggcuuuggagcccguuguuggugccgcuauugcggcaccuguagcgggccaacaaaauguaauugaccccuggauuagaaauaauuuuguacaagccccugguggggaguuuacaguauccccuagaaacgcuccaggugaaauacuauggagcgcgccccuaggcccugaccuaaaucccuaccuaucccauuuggccagaauguacaaugguuaugcaggugguuuugaagugcagguaauucucgcggggaacgcguucaccgccgggaagaucauauuugcagcagucccaccaaauuuuccaacuggaggcuuaaguccuagccaggucacuauguucccccauauaauaguggauguuagacaauuagaaccugugcugauucccuuacccgaugucaggaauaauuucuaucauuacaaucagucaaaugauuccacuauuaaguugauagcaauguuguauacaccacuuagggcuaauaaugcuggggaugauguuuucacaguuucgugccgaguucucacgagaccaucccccgauuuugauuucauauuuuuagugccacccacaguugagucaagaacuaagccauucucugucccaguuuuaacuguugaggagaugaccaauucaagauuccccauuccuuuggaaaaguuguucacgggccccagcagugccuuuguuguucaaccacaaaacggcaggugcacaacugauggcgugcuucuaggcaccacccaacugucuccugucaacaucugcaccuucagaggggaugucacccacaucacagguagucgcaacuacacaaugaauuuggcuucucaaaauuggaacaacuaugacccaacagaagaaaucccagcaccucuaggaacuccagauuuuguggggaagauccaaggcaugcucacccaaaccacaaggacagaugguccaacacgcggccacaaagcuacaguguacacugggagcgccgacuuugcuccaaaacuggguagaguucaauuugaaacugacacagaccaugauuuugaagcuaaucaaaacacaaaguucaccccagucggugucauccaagaugguagcaccacccaccgaaacgaaccccaacagugggugcucccaaguuacucaggcagaaauacucacaauguacaucuggcccccgcuguagcccccaccuuuccgggugagcaacuucucuucuucagauccaccaugcccggaugcagcggguaccccaacauggauuuggacugucugcucccccaggaaugggugcaguacuucuaccaagaggcagccccagcacaaucugauguggcucugcuaagauuugugaauccagacacagguaggguuuuguuugagugcaagcuucacaaaucaggcuauguuacaguggcucacacuggccaacaugauuugguuaucccccccaaugguuauuucagauuugaggccugguaa

SEQ ID NO: 8569 - RNA, 1560 nt, Artificial Sequence
  VP1__Norovirus_and/or_Norovirus-like__JN222366
augaugauggcgucuaaggacgccccaacauccccugauggcgccaguggcgccggccagcugguaccggaggcuaauacagcugagcaaauuucaauggacccuguugcgggugcuucaacagcagucgcgacggcugggcaagugaauaugauugacccauggauuuuuaauaacuuuguccaggcaccucaaggagaauucacuauuuccccuaauaauacccccggugauauuuuguuugauuuacaauugggaccccaccuuaauccauuucuagcccaucucucacagauguauaaugguugggucggcaauaugcgugugcgcauacuguuggccgggaaugccuuuacagcuggaaagauaaucauuugcuguguccccccuggcuuugaugcuagaauacuuacaauagcucaagcaacccucuucccacacuuaauugcugauguuaggacccuugagccuguggagcuuccuuuggaggaugugcgcaacguucucuaccacaauaguagucagccgcagccaacaaugcggcugguugcuauguuguacacuccccuccgcacugguggugguucuggaggcacugaugccuuugugguggcggguagggugcuuacgugccccgcccccgauuuuaguuuccuguuucuuguuccucccuccguugaacaaaagacuagaguuuucaguguccccaauauaccccugaaagaucucucaaauucucguguccccguacccauacagggcauguuuauguccccagauguuaaucagucaguccaguuucagaaugggcgcugccagauugauggucaacuccagggcaccaccccagucucgcucagccaacucugcaagauuagggguaaaacuucuaguaaugccagggugcucaacuuaagcgagguagauggcacaccuuuuaucccccuugaaucaccagcgccaguugguuuucccgacuuaggagguugugacuggcaugugaauuucacuuuccaggcucaaaaccaggacccaucccaaagugugaccuuugcaacuaaugaugccagcuuugucccuuaccuagguagcauuuccccucauaaugggggagacuuucaugcaggcgacaucauagguagccuuggauggauuucagccccgucugacaauucacaacuuaauguuuggacaauaccaaaguacggaucuagucucccagaugucacucaucuugcuccugcuguguuccccccaggcuuuggggaagugauccuauacuucuauucuaccuucccagguucuggacaaccuagucaacuucaagucccauguuuguugccccaggaguucaucacccacuucuguaaugaacaagcucccaucgcuggggaggcugcucuccuccacuacguggacccugauacgggccggaacuugggggaguucaaacuuuacccugauggauuuaugaccugugucccuaauaguguuagcaguggcccucaaacccuaccuaucaauggagucuuugucuuuguuucauggguguccagauaa

SEQ ID NO: 8570 - RNA, 1557 nt, Artificial Sequence
  VP1__Norovirus_and/or_Norovirus-like__KM386679
augaagauggcgucgaaugacgcuacuccaucaaaugauggugcugccggccucgugccagaaaguaacaaugaggcaauggcucuggaacccguggugggggcguccuuagccgccccugucacuggccaaacuaauauaauagaccccuggauuagaacuaauuuuguccaagcccccaauggugaauucacaguuuccccuagaaauuccccuggagagauauuggucaauuuggaguuagguccagaacugaacccuuaucuggcacauuuagcuaggauguacaaugguuaugcgggugguauggaggugcaagugaugcucgcggggaacgcguucacugcuggcaagaucaucuuugccgccgugccaccuuacuuuccaguggaaaaucuuagcccuucccaaauaacaauguucccacaugugauuaucgauguuagaaccuuagaaccuguacugcucccaaugccugaugucagaagcacccuuuuccacuuuaaucaaaaggaugaaccuaagaugagacuuguugccaugcuuuacaccccucuucguucuaauggcucuggugaugacguuuucacugucucauguaggauccucacuaggcccuccccugaauuugauuucacauacuuggugccaccaacaguggagucaaagaccaagccauucacacuaccugugcugacacugggagaauuguccaauucuagauucccucucucuauugaugaaauggucaccagcccuaaugaguccauaguuguucagccacagaaugguagggucacacuagauggggaguuguuaggcacgacccaacugcaagcauguaacauuuguuccauaagggggaaagugacaggacaggucccuaaugaacaacacauguggaaccuggagauuacaaaccuaaaugggacgcaauuugacccuacagaugaugucccagccccucuuggugugcccgacuuugcaggugaggucuuugguguacucagccagagaaauagaggugaaagcaauccagcaaacagggcucaugaugcugucguggcuaccuacagugauaaauacaccccuaaauugggcuuagugcaaauugggacuuggaacaccaacgauguugaaaaccagccaacaaaauucaccccaauugguuugaaugaggucgccaauggccaucgauuugaacaguggacuuugccuagguauucuggcgcccugacacuaaauaugaauuuagcuccugcuguggccccgcucuuuccuggagagcgucuccuuuucuuccguucuuacgucccauuaaaagguggauuuggaaacccugcuauagauugucuagugccucaggaguggguccaacauuucuaucaggaaucugccccaucucugggggauguggccuuagucagguacgucaacccagacaccgggcgcguccuuuuugaggccaaacuccacaaagguggguuccugaccgugucaagcacuagcacagggccugucguggucccagccaauggcuauuucagauuugauuaa

SEQ ID NO: 8571 - RNA, 1551 nt, Artificial Sequence
  VP1__Norovirus_and/or_Norovirus-like__AY549156
augaagaugacugacagagauacuguugauuccgcuccggcacucggacagguccucccuccugaggucgaggcguccguccccguugagccaacagccggcgcuccugucgccgcccccaccgcuggacaggucaacccaauugacccauggauuuuugccaauuuugugcaggccccccagggagaauucaccauaucuccaaauaauaacccuggugagauuuuauuugaguuagaacuuggcccugauuugaaucccuauuuggcccaccuucgccgcauguauaauggguggaccggauccaugcgcgugcggguccuccuugccgggaacgccuuuucggcgggcaagguggugguguucuguguuccuccuggguuugauaccuccuauuugaccccaucccaggcuacccaguuuccccauguguugauugaugugcgcgccccagagccuguugagaugccccuugaagauguucgcaacauccucuuccaccaggggcccgauucgcgcaugaggcucauggggaugcuuuacaccccccugcgugccaauuccggugcagacccuuuugucgucaccggucguguccuuacuuguccuagccccaacuuuuccuucuucuucuuggucccuccuacuguugaggaaagggagccucccuuuacuuugccaaaucugcccgucaauaaucuuucacauucccggguuauggagccgauagcccagaugaugagcucucgcaauuuuccagccucaguucaguuccagaacggccgcugcacccuuucuggcgaccuucuggguacgacuccaucaucccccgcugauuugggugccuuuguaggccugagagcugagccugggucccggguuguugaauugucccaaccuaaccaggaggauuuucaugcuggauccgcuccugccccuuuuggcuuuccagauuuuuccgauugcucagugaccuuugugguggccagcgcgacaacuguuggggagcgcaccgugaacacccgcagccugcaaaauuucacccccgcucuugggcacaucaccuucgaugaggaggccccugccgaccuguuucgggcccacuuccggaaccucugggaaccaacugagcauucauucuggaggauuccggacuaucgagcugaugugcuuggcucugauuuugcuccuucuguuucagccccaggcguuggugagacucuucuuuucuuuaugugcaacgucccucgucugaauggugccaauccuaauccuugccccuguuugcucccucaggaguggauuacccauuuuguuucugagcgcgccgcccuucagagcgacguggcacuuuugaauuauguuaaucccaacacuggccggguccuguuugaggccaaguuguaugccaacgguuuccuuaccgucaaucuuggugccccggaccaggcaacccuaccuguggaugggauauucaaauuuguuuccuggguuucuucuuauuaucaguugcggccugugggaaaugcuagugcuggucgccgccucuaa

SEQ ID NO: 8572 - RNA, 1551 nt, Artificial Sequence
  VP1__Norovirus_and/or_Norovirus-like__AY549163
augaagaugacugacagagauacuaucgauuccgccccggcgcucgggcagguccucccuccugaggucgaggcguccguccccguugagccaacagccggcgcuccugucgccgcccccaccgcuggacagguuaacccgauugauccauggauuuuugcuaauuuugugcaggccccccagggagaauuuaccauauccccaaauaauaauccuggugagauuuuauuugaauuagagcuuggcccugauuugaaucccuauuuggcccaccuucgccgcauguacaauggauggaccggauccaugcgcgugcggguccuccuugcggggaaugccuuuucggcaggcaagguggugguguuuugugucccuccuggauuugauaccucuuaccugaccccaucccaggcuacccaguucccucaugugcugauugaugugcgcgccccagagccuguugagaugccccuugaggauguucguaacauccucuuccaucagggacccgauucgcgcaugaggcucauggggaugcucuauaccccccugcgugccaacuacggugcagacccuuuugucgucaccggccguguucuuacuuguccuagccccaauuucuccuuuuucuuccuggucccuccuacuguugaggaaagggagacucccuuuacuuugccaaauuugcccgucaauaaucucucacauucccggguuauggagccgauagcccagaugaugagcucucgcaauuuuccagccucaguucaguuccagaacggucgcugcacucuuucuggcgaccuccuggguacgacuccaucaucccccgcugauuugggugccuuuguaggcuugagagcugagccugggucccggguuguugaauugucccaaccuaaccaggaggauuuccaugcuggauccgcucccgcccccuuuggcuuuccagauuuuuccgauugcucagugacuuuugugguggccagcgcgacaacuguuggggagcgcacugugaauacccguagccugcaaaauuuuacccccgcccuugggcacaucaccuucgaugaggaggccccugccgaccuguuucgggcccacuuccggaaccucugggaaccaacugagcauucauucuggaggaucccagacuaucgagcugaugugcuuggcucugauuuugcuccuucuguuucagccccagguguuggugagacucuucuuuucuuuaugugcaaugucccucguuugaauggugccaaucccaaucccugccccuguuugcucccgcaagaauggaucacccauuuuguuucugagcgcgccgcccuucagagcgacguggcacuuuugaauuauguuaaucccaacacuggccggguccuguuugaggccaaauuguaugccaacgguuuucuuaccgucaaccuuggcgccucggaccaggcaauccuaccuguggauggaauauuuaaauuuguuuccuggguuucuuuuuauuaucaguugcggccugugggaaaugcuagugucggccgccgccuuuaa

SEQ ID NO: 8573 - RNA, 1551 nt, Artificial Sequence
  VP1__Norovirus_and/or_Norovirus-like__AY549159
augaagaugacugacagagauacuguugauucugcuccggcgcucggacagguccucccuccugaggucgaggcguccguccccguugagccaacagccggcgcucccgucgccgcccccaccgcuggacagguuaauccgauugauccauggauuuuugccaauuuugugcaggccccccagggagaauucaccauauccccaaacaauaacccuggugagauucuauuugaauuagaacuuggcccugauuugaaccccuauuuggcccaccuucgccgcauguauaauggauggaccggauccaugcgcgugcggguccuccuugcggggaaugccuuuucggcaggcaagguggugguguuuugugucccuccuggauuugauaccuccuacuugaccccaucccaggcuacccaguucccucaugugcugauugaugugcgcgccccagagccuguugagaugccccuugaagauguucgcaacauccucuuccaccaggggcccgauucgcgcaugaggcucauggggaugcucuauaccccccugcgugccaacuccggugcagacccuuuugucgucaccggucguguucuuacuuguccuagccccaauuucuccuuuuucuuccuggucccucccacuguugaggaaagggagacucccuuuacuuugccaaauuugcccgucaauaaucuuucacauucccggguuauggagccgauagcccagaugaugagcucucgcaauuuuccagccucaguccaguuccagaacggucgcugcacucuuucuggcgaccuccuggguacgacuccaucaucccccgcugauuugggugccuuuguaggcuugagagcugagccugggucccggguuguugaguugucccaaccuaaccaggaggauuuccaugcuggauccgcucccgcccccuuuggcuuuccagauuuuuccgauugcucagugacuuuugugguggccagcgcgacaacuguuggggagcgcacugugaaugcccguagccugcaaaauuucacccccgcccuugggcauaucaccuucgaugaggaggccccugccgaccuguuucgggcccaccuccggaaccucugggaaccaacugagcauucauucuggaggaucccggacuaucgagcugaugugcuuggcucugauuuugcuccuucuguuucagccccagguguuggugagacucuucuuuucuucaugugcaauguuccucguuugaauggugccaauccuaaucccugccccugcuugcucccgcaagaauggauuacccauuuuguuucugagcgcgccgcccuucagagcgacguggcacucuugaauuaugucagucccaauacuggccggguccuguuugaggccaaauuguaugccaacgguuuucucaccgucaaccuuggcgccucggaccaggcgacccuaccuguggauggaauauuuaaauuuguuuccuggguuucuuuuuauuaucaguugcggccugugggaaaugcuaguguuggccgccgucuuuaa

SEQ ID NO: 8574 - RNA, 1551 nt, Artificial Sequence
  VP1__Norovirus_and/or_Norovirus-like__AY549166
augaagaugacugacagagacacuguugauuccgccccggcgcucggacagguccucccuccugagguugaggcguccguucccguugagccaacagccggcgcuccugucgccgcccccaccgcugggcagguuaacccgauugacccauggauuuuugccaauuuugugcaggccccccagggagaauucaccauauccccaaauaauaacccuggugagauucuguuugaauuagaacuuggcccugauuugaaucccuauuuggcccaccuucgccgcauguauaauggauggaccggauccaugcgcgugcggguccuccuugcggggaaugccuuuucggcaggcaagguggugguguucugugucccuccuggauuugauaccuccuaccugaccccaucccaggcuacccaguucccucaugugcugauugaugugcgcgccccagagccuguugaaaugccccuugaagauguccgcaacauccucuuccaccaggggccugauucgcgcaugaggcucauggggaugcucuacaccccccugcgugccaacuccggugcagacccuuucgucgucaccggucguguucuuacuuguccuagccccaauuucuccuuuuucuucuugguuccuccuacuguugaagaaagggagacucccuuuacuuugccaaauuugcccgucaauaaccuuucacauucccggguuauggagccgauagcccagaugaugagcucucgcaauuuuccagccucaguccaauuccagaacggucgcugcacucuuucuggcgaccuccuggguacgacuccaucauccccugcugauuugggugccuuuguaggcuugagagcugagccugggucccggguuguugaguuaucccagcccaaccaggaggauuuucaugcuggauccgcucccgcccccuuuggcuuuccagauuuuuccgauugcucagugaccuuugugguggccagcgcgacaacuguuggggagcgcacugugaauacccguagccugcaaaauuuuacccccgcccuugggcacaucaccuucgaugaggaggccccugccgaccuguuucgggcccacuuccggaaccucugggaaccaacugagcauucauucuggaggaucccggacuaucgagcugacgugcuuggcucugauuuugcuccuucuguuucagccccagguguuggugagacucuucuuuucuuuaugugcaauguuccucguuugaauggugccaaucccaaucccugccccuguuugcucccgcaagaauggaucacccauuuuguuucugagcgcgccgcccuucagagcgacguggcacuuuugaauuauguuaaucccaacacuggccggguccugcuugaggccaaauugugugccaacgguuuucuuaccgucaaccuuggcgccucggaucaggcaacccuaccuguggauggaauauuuaaauuuguuuccuggguuucuuuuuauuaucaguuacggccugugggaaaugcuaguguuggccgccgccucuaa

SEQ ID NO: 8575 - RNA, 1551 nt, Artificial Sequence
  VP1__Norovirus_and/or_Norovirus-like__AF320113
augaagaugacugacagagacauuauugauuccgcuccggcgcucggacaaguucucccuccugaggucgaggcguccguccccguugagccaacagccggcgcuccugucgccgcccccacugcugggcagguuaauccaauugacccauggaucuuugccaauuuugugcaagcuccccagggggaguuuaccauauccccuaauaauaacccuggugagauucuguuugagcuggaacuuggcccugauuugaaccccuaccuggcccaccuccgccgcauguacaacggguggaccggguccaugcgcgugcgagugcuccuggcggggaaugccuucuccgcaggcaaaguggugguguuuugugucccuccuggguuugauaccuccuaucugaccccaucucaggccacucaguuuccccaugugcugauugaugugcgcgccccagagccuguugagaugccccuugaagauguucgcaacauccuuuuccaucaggggcccgacucgcgcaugaggcucauggggaugcuguacaccccccugcgugccaacucuggugcggacccauucguuguuaccggccgaguccugcccugcccuagccccaauuuuuccuuuuucuucuuggucccccccaccguugaggaaagggagcccccuuuuaccuugccaaauuugcccgucaauaaucuuucacauucccggguuauggagccgauagcccagaugaugagcucucgcaccuuuccagccucaguucaguuucaaaauggccgcugcacucucucuggcgaucucuugggcacgacccccucaucuccuuccgaccugggugccuuugugggccugauugcugagccugggucucggguuguugaauuguuccagccuaaucaggaagauuuucaugccgggucugcuccugccccucuuggcuuuccagauuuuuccgauugcucuuugaccuuugugguggcuagugcgaccaccguuggggagcgcaccgugaacgcccgcagccuucaaaauuucaccccugcccucgggcauaucaccuuugaugaggaggccccugcugauuuguuccgggcccaccuccggaaccuuugggacccaacugagcauucauuuuggaggaucccggacuaccgagccgaugugcuuggcucugaguuagccccuucuguuucugccccagguguuggugaaacucuucucuucuuuacgugcaauguuccccguuugaauggcgcuaaucccaaucccugccccuguuugcuuccucaggaguggaucacccauuuuguuuccgagcgugccgcccuucaaagcgauguggcgcucuugaauuauguuaaucccaacaccgggcggguccuguucgaggcgaagcuguaugucaauggcuuccucaccgucaaccucggcgccucagaucaggcgacccugcccguggacgggauauuuaaauuuguuuccuggguuucuuuuuauuaucaguugcggccugugggaaaugcuaguguuggucgccgucuuuaa

SEQ ID NO: 8576 - RNA, 1551 nt, Artificial Sequence
  VP1__Norovirus_and/or_Norovirus-like__AY549153
augaagaugacugacagagacacuguugacuccgcuccggcgcucgggcaaguccucccuccugaggucgaggcguccguccccguugagccaacagccggcgcuccugucgccgcccccacugcugggcaggucaacccaauugauccauggauuuuugccaauuuuguacaggccccccagggggaguucaccauaucuccaaauaauaauccuggugagauccuguuugaauuagagcuuggcccugauuugaaucccuauuuggcccaccuucgccgcauguacaacggguggacuggguccaugcgcgugcggguccuccuugcggggaacgccuuuucagcaggcaagguggugguguuuugugucccuccuggauuugauaccuccuauuugaccccgucccaggccacucaguucccccaugugcugauugaugugcgcgccccagagccuguugagaugccccuugaagauguucgcaacauccuuuuccaccaggggccugacucacgcaugaggcucauggggaugcuuuacaccccuuugcgcgccaauuccggcgcagacccuuucgucguuacuggccguguucuuacuuguccuagccccaauuucucuuucuucuuucuggucccucccacugucgaggagagagagccccccuuuaccuugccaaacuugccugucaacaaucuuucacauucccgggucauggagccgauagcccagaugaugaguucucgcaguucuccagccucaauccaguuccagaacggccgcugcacucuuucuggcgaccuucugggcacgacuccaucguccccugcugauuugggugcuuuuguaggccugagagcugagccuggcucccauguuguugaacugucucagcccaaucaagaggauuuucaugcaggguccgccccugcccccuuuggcuuuccagauuuuuccgauuguucugugacuuuugugguugccagcgcaacaauuguugagcagcgcacuguaaaugcccgcagccugcaaaacuuuacuccugcccuggggcauauuaccuuugaugaagaagcuccugcugauuuguuucgggcccgcuuucgaaaugucugggacccaacugagcauucguucuggaggauuccggacuaucgggcugauguacuugguucagauuuugcucccucuguuucagccccggguguuggugaaacucuccuuuucuucauguguaauguuccccauucgaauggugcuaauccuaauccuugccccuguuugcucccucaagaauggauuacccauuuuguuuccgagcgcgccgcccuucagggcgacguggcgcuuuugaauuacauuaaucccaacaccggccggguuucguuugaggccaagcuguacgccaaugguuuucuuaccgucaaccuuggcgccucggaccggacgacccugccgguggaugggauauucaaauuuguuuccuggguuucuuuuuauuaucaguugcggccugugggaaaugcuagcguuggccgccgccucuaa

SEQ ID NO: 8577 - RNA, 1551 nt, Artificial Sequence
  VP1__Norovirus_and/or_Norovirus-like__AY549157
augaagaugacugacagagauacuguugauuccgcuccggcacucggacagguccucccuccugaggucgaggcguccguccccguugagccaacagccggcgcuccugucgccgcccccaccgcuggacaggucaacccaauugauccauggauuuuugccaauuuugugcaggccccccagggagaauucaccauaucuccaaauaacaacccuggugagauuuuauucgaguuggaacuuggcccugauuugaaucccuauuuggcccaccuucgccgcauguacaauggauggaccggguccaugcgcgugcggguccuccuugccgggaacgccuuuucggcgggcaagguggugguguucugugucccuccuggguuugauaccuccuauuugaccccaucccaggcuacccaguuuccccaugugcugauugaugugcgcgccccagagccuguugagaugccccuugaagauguucgcaacauccucuuccaccaggggcccgauucgcgcaugaggcucauggggaugcuuuacacccccuugcgugccaacuccggugcagacccuuuugucgucaccggucguguucucacuuguccuagccccaauuuuuccuucuucuucuuggucccuccuacuguugaggaaagggaaccccccuuuacuuugccaaaucugcccgucaauaaucuuucacauucccggguuauggagccgauagcccagaugaugagcucucgcaauuuuccagccucaguucaguuccagaacggccgccgcacucuuucuggcgaccuucuggguacgaccccaucauccccugcugauuugggugccuuuguaggccugagagcugagccugggucccggguuguugaauugucccaaccuaaccaggaggauuuucaugcuggguccgcuccugccccuuuuggcuuuccagauuucuccgauugcucagugaccuuugugguggccagcgcgacaacuguuggggagcgcacugugaauacccgcagccugcaaaauuucacccccgcucuugggcacaucaccuucgaugaggaggccccugccgaccuguuucgggcccacuuccggaaccucugggaaccaacugagcauucauucuggaggauuccggacuaucgagcugaugugcuuggcucugauuuugcuccuucuguuucagccccaggcguuggugagacucuucuuuucuuuaugugcaaugucccccgucugaauggcgccaauccuaaccccugccccuguuugcucccucaggaguggauuacccauuuuguuucugagcgcgccgcccuucagagcgacguggcacuuuugaauuacguuaaucccaacacuggccggguccuguuugaggccaaguuguaugccaacgguuuccucaccgucaaucuuggugccucggaccaggcaacccugccuguggaugggauauuuaaauuuguuuccuggguuucuuuuuauuaucaguugcggccugugggaaaugcuaguguuggccgccgccucuaa

SEQ ID NO: 8578 - RNA, 1551 nt, Artificial Sequence
  VP1__Norovirus_and/or_Norovirus-like__AY549158
augaagaugacugacagagaugcuguugauuccgcuccggcacucggacagguccucccuccugaggucgaggcauccguucccguugagccaacagccggcgcuccugucgccgcccccaccgcuggacagguuaauccaauugacccauggauuuuugccaacuuugugcaggccccccagggagaauucaccauaucuccaaauaauaacccuggugagauuuuauuugaguuagagcuuggcccugauuugaaccccuauuuggcccaccuucgccgcauguacaauggauggaccggauccaugcgcgugcggguccuccuugccgggaacgccuuuucggcgggcaagguggugguguuuugugucccuccuggguuugauaccuccuauuugaccccgucccaggcuacccaguuuccccaugugcugauugaugugcgcgccccagagccuguugagaugccccuugaagauguucgcaacauccucuuccaccaggggcccgauucgcgcaugaggcucauggggaugcuuuacaccccccugcgugccaauuccggugcagacccuuuugucgucaccggucguguucuuacuuguccuagccccaauuuuuccuucuuuuucuuggucccuccuacuguugaggaaagggagccucccuucacuuugccaaaucugcccguuaauaauccuucacauucccggguuauggagccgauagcccagaugaugagcucucgcaauuuuccagccucaguucaguuccagaacggccgcuguacccuuucuggcgaccuucuggguacgacuccgucaucccccgcugauuugggugccuuuguaggccugagagcugagccugggucucggguuguugaauugucccaaccuaaccaggaggauuuucaugcuggguccgcucccgccccuuuuggcuuuccagauuuuuccgauugcucagugaccuuuguaguggccagcgcgacaacuguuggggagcgcacugugaacacccgcagccugcaaaauuucacccccgcucuugggcacaucaccuucgaugaggaggccccugccgaccuguuucgggcccacuuccggaaccucugggaaccaacugagcauucguucuggaggauuccggacuaucgagcugaugugcuuggcucugauuuugcuccuucuguuucagccccaggcguuggugaaacucuucuuuucuuuaugugcaacgucccucgucugaauggugcuaauccuaacccuugccccuguuugcucccccaggaguggauuacccauuuuguuucugagcgcgccgcccuucagagcgacguggcacuuuugaauuauguuaaucccaacacuggccggguccuauuugaggccaaguuguaugccaacgguucccuuaccgucaaccuuggugccucggaccaggcaacccuaccuguggaugggauauuuaaauuuguuuccuggguuucuuuuuauuaccaguugcggccugugggaaaugcuaguguuggucgccgccucuaa

SEQ ID NO: 8579 - RNA, 1551 nt, Artificial Sequence
  VP1__Norovirus_and/or_Norovirus-like__AY549165
augaagaugacugacagagacacuguugauuccgcuccggcgcucgggcaaguccucccuccugaggucgaggcguccguccccguugagccaacggccggcgcuccugucgccgcccccacugcugggcaggucaacccuauugauccauggauuuuugccaauuuugugcaggccccccagggggaguuuaccauaucuccaaauaauaacccuggugagauccuauuugaauuagagcuuggcccugauuugaaucccuaucuggcccaccuucgccgcauguacaacggguggacuggguccaugcgcgugcggguccuccuugcggggaacgccuuuucggcaggcaagguggugguguuuugugucccuccuggauuugaugccuccuauuugaccccuucccaggccacucaguucccccaugugcugauugaugugcgcgccccagagccuguugagaugccccuugaagauguccgcaacauccucuuccaccaggggccugacucacgcaugaggcucauggggaugcuuuauacccccuugcgcgccaacuccggugcagacccuuuuguuguuacuggccguguucuuacuuguccuagccccaauuucucuuucuucuuucugggcccucccacugucgaggaaagggagccccucuuuaccuugccaaacuugccugucaacaaucuuucacauucccgggucauggagccgauagcccagaugaugaguucucgcaguuucccagccucaguccaguuccagaacggccgcugcacucuuucuggcgaccuucugggcacgacuccaucguccccugcugaucugggugcuuuugugggccugagagcugagccuggcucccauguuguugaauugucucagcccaaucaagaggauuuucaugcaggauccgccccugcccccuuuggcuuuccagauuuuucugguuguucugugacuuuugugguugccagugcaacaauuguugagcagcgcacuguaaauacccgcagccugcaaaauuuuacuccugcccuggggcacauuaccuuugaugaagaagcuccugcugauuuguuucgggcccgcuuucgaaacgucugggacccaacugagcauucguucuggaggauucccgacuaucgggcugauguacuugguucagauuuugcucccucuguuucagccccgggugguggugaaacucuucucuucuucauguguaauguuccccauucgaauggugcuaacccuaauccuugccccugcuugcucccucaagaauggaucacccauuuuguuuccgagcgcgccgcccuccagggcgacguggcgcucuugaauuauauuaaucccaacaccggucggguuuuguuugaggccaagcuguaugccaaugguuuucuuaccgucaaccuuggcgccucggaccaggcggcccugccgguggaugggauauucaaauuuguuuccuggguuucuuuuuauuaucaguugcggccugugggaaaugcuagcguuggccgccgccucuaa

SEQ ID NO: 8580 - RNA, 1551 nt, Artificial Sequence
  VP1__Norovirus_and/or_Norovirus-like__AY549167
augaagaugacugacagagacacuguugacuccgcuccggcgcucgggcaaguccucccuccugaggucgaggcguccguccccguugagccgacagccggcgcuccugucgccgcccccacugcugggcaggucaacccaauugauccauggauuuuugccaauuuugugcaggccccccagggggaguuuaccauaucuccaaauaauaauccuggugagauccuauuugaauuagagcuuggcccugauuugaaucccuauuuggcccaccuucgccgcauguacaacggguggacuggguccaugcgcgugcggguccuccuugcggggaacgccuuuucggcaggcaagguggugguguuuugugucccuccuggauuugauaccuccuacuugaccccgucccaggccacucaguucccccaugugcugauugaugugcgcgccccagagccuguugagaugccccuugaagauguucgcaacauccuuuuccaccaggggccugacucacgcaugaggcucauggggaugcuuuacacccccuugcgcgccaacuccggugcagacccuuucgucguuacuggccguguucuuacuuguccuagccccaauuucucuuucuucuuucuggucccucccacugucgaggaaagggagccccucuuuaccuugccaaauuugccugucaacaaucuuucacauucccgggucauggagccgauagcccagaugaugaguucucgcgguuuuccagccucaguccaguuccagaacggccgcugcacucuuucuggcgaccuucugggcacgacuccaucguccccugcugaucugggugcuuuuguaggccugagagcugagccuggcucccauguuguugaacugucucagcccaaucaagaggauuuucaugcaggguccgcuccugcccccuuuggcuuuccagauuuuuccgacuguucugugacuuuugugguugccagugcaacaauuguugagcagcgcacuguaaaugcccgcagccugcaaaauuuuacuccugcccuggggcacauuaccuuugaugaagaagcuccugcugauuuguuucgggcccgcuuucgaaacgucugggacccaacugagcauucguucuggaggauuccggacuaucgggcugauguacuugguucagauuuugcucccucuguuucagcuccggguguuggugaaacucuucucuucuuuaugugcaauguuccccacucgaguggugcuaauccuaauccuugccccugcuugcucccucaagaauggauuacccauuuuguuuccgagcgcgccgcccuccagggcgacguggcgcuuuugaauuauauuaaccccaacaccggccggguuuuguuugaggccaagcuguaugccaaugguuuucuuaccgucaaccuuggcgccucggaccaggcgacccugccgguggaugggauauuuaaauuuguuucuuggguuucuuuuuauuaucaguugcggccugugggaaaugcuaguguuggccgccgccucuaa

SEQ ID NO: 8581 - RNA, 1551 nt, Artificial Sequence
  VP1__Norovirus_and/or_Norovirus-like__AY549154
augaagaugacugacagagauacuguugaucccgcuccggcacucggacagguccucccuccugaggucgaggcguccguccccguugagccaacagccggcgccccugucgccgcccccaccgcuggacagguuaacccaauugacccauggauuuuugccaauuuugugcaggccccccagggagaauuuaccauaucuccaaacaacaacccuggugagauuuuauuugaguuagaacuuggcccugauuugaaucccuauuuggcccaucuucgccacauguauaauggauggaccggauccaugcgcgugcggguccuccuugccgggaacgccuuuucggcgggcaagguggugguguuuugugucccuccuggguuugauaccuccuauuugaccccaucccaggcuacccaguuuccccaugugcugauugaugugcgcgccccagagccuguugagaugccccuugaagauguucgcaacauccucuuccaccaggggcccgauucgcgcaugaggcucauggggaugcuuuacaccccccugcgugccaauuccagugcagacccuuuugucgucaccggucguguucucacuuguccuaaccccaauuuuuccuucuucuucuuggucccuccuacuguugaggaaagggagccccccuuuacuuugccaaacuugcccgucaacaaucuuucacauucccggguuauggagccgauagcccagaugaugagcucucgcaauuuuccagccucaguccaguuccagaauggccgcugcacucuuucuggcgaccuucuggguacaacuccaucaucccccgcugauuugggugccuuuguaggccugagagcugagccugggucccggguuguugaauugucccaaccuaaccaggaggauuuucaugcuggguccgcuccugccccuuuuggcuucccagauuuuuccgauugcucagugaccuuugugguggccagcgcgacaacuguuggggagcgcacugugaacacccgcagccugcaaaauuuuacccccgcucucgggcacaucaccuucgaugaggaggccccugccgaccuguuucgggcccacuuccggaaccucugggagccaacugagcauucguucuggaggauuccggacuaucgagcugauguacuuggcucugauuuugcuccuucuguuucagccccagguguuggugaaacucuucuuuucuuuaugugcaaugucccucguuugaauggugccaacccuaacccuugccccugcuugcuuccucaggaguggauuacccauuuuguuucugagcgcgccgcccuucagagcgacguggcacuuuugaauuacguuaaucccaacacuggccggguccuguuugaggccaaguuguaugccaacgguuuccuuaccgucaaucuuggugccucggaccaggcaacccuaccuguggaugggauauucaaauuuguuuccuggguuucuuuuuauuaucaguugcggccugugggaaaugcuaguguuggucgccgccucuaa

SEQ ID NO: 8582 - RNA, 1551 nt, Artificial Sequence
  VP1__Norovirus_and/or_Norovirus-like__AY549155
augaagaugacugacagagacacuguugauuccgcuccggcacucggacagguccucccuccugaggucgaggcguccguccccguugagccaacagccggcgcuccugucgccgcccccaccgcuggacagguuaacccaauugacccauggaucuuugcuaauuuugugcaggccccccagggagaguucaccauaucuccaaauaacaacccuggugagauuuuauuugaguuggaacuuggcccugauuugaaucccuauuuggcccaccuucgccgcguguauaauggauggaccggauccaugcgcgugcggguccuccuugccgggaacgccuuuucggcgggcaagguggugguguuuugugucccuccuggguuugauaccuccuauuugaccccaucccaggccacccaguuuccccaugugcugauugaugugcgcgccccagagccuguugagaugccccuugaggauguucgcaacauccucuuccaccaggggcccgauucacgcaugaagcucauggggaugcuuuacaccccccuacgcgccaauuccagugcaaacccuuuugucgucaccggucgcguucucacuuguccuagccccaauuuuuccuucuuuuucuuggucccuccuacuguugaggaaagggagccccccuuuacuuugccaaaucugcccguuaacaaucuuucacauucccaaguuauggagccaauagcccaaaugaugaguucucgcaauuuuccagcuucaguccaguuccaaaacggccgcugcacucuuucuggcgaccuccuggguacaacuccaucaucccccgcugauuugggugccuuugugggccugagagcugagccugggucccggguuguugaauugucccagccuaaccaggaggauuuucaugcuggguccgcuccugccccuuuuggcuuuccagauuuuuccgauugcucagugaccuuugugguggccagcgcgacaacuguuggggagcgcacuguaaaugcccgcacccugcaaaauuuuacccccgcucuugggcacaucacuuucgaugaggaggccccugccgaucuguuucgggcccacuuccggaaccucugggaaccaaccgagcauucguucuggaggauuccggacuaucgagcugaugugcuuggcucugauuuugcuccuucuguuucagccccaggcguuggugaaacucuucuuuucuuuaugugcaaugucccucgucugaauggugccaaucccaacccuugccccuguuugcucccucaggaguggauuacccauuuuguuucugagcgcgccgcccuccagagcgacguggcacuuuugaauuaugucaaucccaacacuggccggguccuguuugaagccaaguuguaugccaacgguuuccuuaccgucaaucuuggugccucggaccaggcaacccuaccuguggaugggauauucaaauuuguuuccuggguuucuuuuuauuaucaguugcggccugugggaaaugcuaguguuggucgccgccucuaa

SEQ ID NO: 8583 - RNA, 1551 nt, Artificial Sequence
  VP1__Norovirus_and/or_Norovirus-like__AF320625
augaagaugacugacagagacauuauugauuccgcuccggcgcucggacaaguccucccuccugaggucgaggcguccguccccguugagccaacagccggcgcucccgucgccgcccccacugcugggcaggucaauccaauugacccauggauuuuugccaauuuugugcaagccccccagggaguguuuaccauaucccccaauaauaacccuggugagauucuauuugagcuggaacuuggcccugauuugaaccccuaccuggcucaccuccgccgcauguacaauggguggacuggguccaugcgugugcgagugcuccuggcggggaaugcuuucuccgcaggcaagguggugguguuuugugucccucccggguuugauaccuccuaucugaccccaucccaggccacucaauucccucaugugcugauugaugugcgcgccccagaaccuguugagaugccccuugaagauguucgcaacauccuuuuccaccaggggcccgacucgcgcaugaggcucauggggauguuguacacuccccugcgugccaauucuggugcggacccauuuguuguuaccggccgaguccucaccugcccuagccccaauuucuccuuuuucuuuuuggucccccccaccguugaggaaagggagcccucuuucacuuugccaaauuugcccguuaauaaucuuucacauucccggguuauggaaccgauagcccagaugaugagcucucgcacuuuuccagccucaguucaauuucaaaacggccgcugcacucucucuggcgaucucuugggcacgacccccucaucuccuuccgaccugggcgccuuugugggccugauugccgagccugggucucggauuguugaauugucccagccuaaccaggaagauuuucaugccgggucugcuccugccccuuuuggcuuuccagauuuuuccgauugcucuuugaccuuugugguggcuagugcgacuaccguuggggagcgcaccgugaaugcccgcagccuucaaaauuuuacuccugcucuugggcauauuaccuuugaugaggaggccccugcugauuuguuccgggcccaccuccggaaccuuugggacccgacugagcauucauuuuggaggauuccagauuaccgagccgaugugcuuggcucugaguuugccccuucuguuucugccccagguguuggugaaacccuccuuuucuuuauguguaauguuccccguuugaauggcgcuaaucccaacccuugccccuguuugcuuccucaggaguggaucacccauuuuguuuccgagcgugccgcucuucaaagcgauguggcgcucuugaauuauguuaaccccaacaccgggcggguccuguucgaggcgaagcuguacgccaauggcuuccucaccgucaaucuuggugccucagaucaggcgacccugcccguggacgggauauucaaguuugucuccuggguuucuuucuauuaucaguugcggccugugggaaaugcuaguguuggccgccgucucuaa

SEQ ID NO: 8584 - RNA, 1551 nt, Artificial Sequence
  VP1__Norovirus_and/or_Norovirus-like__AY274820
augaagaugacugacagagacacuguugauuccgcuccggcgcucggacaaguccuccccccugagguugaggcguccguccccguugagccaacagccggcgcccccgucgccgcccccacugcuggacagguuaacccaauugacccauggaucuuugccaauuuugugcaggccccccauggugaguuuacuauauccccaaauaauaauccuggugagguuuuguuugaauuaaaguuaggcccugauuugaaucccuauuuggcccaccuucgccgcauguacaauggauggaccggauccaugcgcgugcgaguccuucuugcggggaacgccuuuucggcgggcaagguggugguguuuuguguuccuccuggauuugauaccuccuauuugaccccaucccaggcuacucaguucccccaugugcugauugaugugcgugccccaaagccuguugagaugccccuugaagauguccgcaacauucuuuuccaccaagggcccgauucacgcaugaggcucauggggaugcucuacacccccuugcgcgccaacuccggugcagacccuuucgucgucaccggccguguucuuacuugcccuaguccuaauuucucuuucuucuuuuuggucccucccacuguugaggaaagggagccucccuucacuuugccaaauuugccuguuaacaaucuuucacauucucggguuauggagccgauagcccagaugaugaguucucguaauuuuccagccucaguccaguuccagaacggccgcugcacucuuucuggcgaucuucuggguacgacuccaucaucccccgcugauuugggugccuucguaggccugagagccgagccuggaucccggguuguugaauugucccagcccaaccaggaagauuuccaugcuggguccgcuccugcccccuucggcuuuccagauuuuuccgaauguucugugaccuucaugguggccagugcgacgaccguuggggagcgcacugugaacacucgcagccuccaaaacuuuacccccgcccuugggcauaucaccuuugaugaggaggccccugccgaccuguuucgggcucgcuuccggaaccucugggagccaacugaacauuccuucuggaggaucccggacuaucgagcugauguucuugguucugaguuugcuccuucuguuucagcuccagguguuggugaaacucuccuuuucuuuaugugcaaugucccccgcuugaauggugcuaaucccaacccuugucccugcuugcuuccccaggaauggauuacccauuuuguuucugagcgcgccgcccuccagagcgacguggcgcuccugaauuauguuaaucccaacacuggccggguccucuuugaggccaagcuguaugccaaugguuuucucaccgucaaccuuggugccucggaccaggcguccuugccuguggaugggauauuuaaauuuguuucuuggguuucuuuuuauuaucaguugcggccugugggaaacgcuaguguuggccgccgccucuaa

SEQ ID NO: 8585 - RNA, 1551 nt, Artificial Sequence
  VP1__Norovirus_and/or_Norovirus-like__AF542083
augaagaugacugacagagacacuguugauuccgcuccggcgcucggacagguccucccuccugaggucgaggcguccguccccguugagccaacagccggcgcucccgucgccgcccccaccgcuggacagguuaacccaauugacccauggauuuuugccaauuuugugcaggccccccagggggaauuuaccauaucuccaaauaauaacccuggugagguuuuauuugaauuagaacuuggcccugauuugaauccuuauuuggcccaccuucgccgcauguauaauggauggaccggauccaugcgcgugcggguccuccuugcggggaaugccuuuucggcaggcaagguggugguguuuuguguccccccuggauuugauaccuccuaucugaccccaucccaggcuacccaguuuccccaugugcugauugaugugcgcgccccagagccuguugagaugccccuugaagauguucgcaacauccucuuccaccaggggcccgauucgcgcaugaggcucauggggaugcucuauaccccccugcgugccaacuccggcgcagacccuuuugucgucaccggucguguucucacuuguccuagccccaauuuuucuuucuucuucuuggucccucccacuguugaggaaagggagccccccuuuacuuugccaaauuugcccgucaauaaucuuucacauucccggguuauggagccgauagcccagaugaugagcucucgcaauuuuccagccucaguccaguuccagaacggccgcugcacucuuucuggugaccuucuggguacgaccccgucaucccccgccgauuugggugccuuuguaggccugagagcugagccugggucccggguuguugaauugucccagccuaaccaggaggauuuucauguuggauccgcuccugccccccuuggcuuuccagauuuuuccgacugcucagugacuuuugugguggccagcgcgacaacuguuggggagcgcacugugaauacccguagccugcaaaauuucacccccgcccuugggcacaucaccuucgaugaggaggccccugccgaccuguuucgggcccacuuccggaaccucugggaaccaacugagcauucauucuggaggauuccggacuaucgagccgaugugcuugguucugauuuugcuccuucuguuucagccccagguguuggugaaacucuucuuuucuuuaugugcaauguuccucguuugaauggugcuaaucccaaucccugccccuguuugcuuccucaagaguggauuacccauuuuguuucugagcgcgccgcccuucagagcgacguggcacuuuugaauuauguuaaccccaacacuggccggguccuguuugaggccaacuuguaugccaacgguuuucuuaccgucaaucuuggcgccucggaucaggcaacccuaccuguggauggaauauuuaaauuuguuuccuggguuucuuucuauuaucaguugcggccugugggaaaugcuaguguuggccgccgccuuuaa

SEQ ID NO: 8586 - RNA, 1551 nt, Artificial Sequence
  VP1__Norovirus_and/or_Norovirus-like__EU794907
augaagaugacugacagagacguuacugauuccgcuccggcgcucggacaaguccucccuccugaggucgaggcguccguccccguugagccaacagccggcgcccccgucgccgcccccacugcugggcaaguuaauccaauugacccauggaucuuugccaauuuugugcaagcuccccagggagaguuuaccauaucccccaacaacaacccuggcgagauuuuguuugagcuggaacuuggcccugauuugaaucccuaccuggcccaccuccgccgcauguauaacggguggacugguuccaugcgcgugcgagugcuccuggccgggaaugcuuucuccgcaggcaagguggugguguuuugugucccuccuggguuugauaccuccuaucugaccccaucucaagccacccaguuuccccaugugcugauugaugugcgcgccccagagcccguugagaugccccuugaagauguucguaacauccucuuccaccaggggcccgauucccgcaugagacucauggguaugcuguauacuccccugcgcgccaacucuggugcggaccccuuuguugucaccggccgaguccuuacuugcccuagcccuaauuuuuccuuuuucuuucugguucccccuaccguugaggaaagggagcccccuuuuacuuugccaaauuugccuguuaauaaucuuucacauucccggguuauggaaccgauagcccagaugaugagcucacgcaauuuuccagccucaguccaguuccaaaauggucgcugcacucugucuggcgaccuccugggcacaaccccuucaucuccuuccgaccuaggcgcuuuugugggccugauugccgagccugggucucggguuguugaauugucucagcccaaucaggaagacuuccaugccgggucugcuccugcuccuuuuggcuuuccagauuuuucugauuguucuuuaaccuuuguaguggcuagcgcgaccacuguuggagagcgcacugugaaugcccgcagcccccaaaauuuuaccccugcucuugggcacaucaccuuugaugaggaggccccugcugaucuguuccgggcccaucuccggaaccuuugggacccgacugagcauucauuuuggaggaucccggauuaccgagccgaugugcuugguucugaguucgccccuucugucucugccccagguguuggugaaacucuucucuuuuuuaugugcaaugucccucgcuugaauggcgcuaaucccaauccuugucccuguuugcucccccaggaguggauuacccacuuugucuccgagcgcgccgcccuucaaagcgauguggcgcuuuugaauuauguuaaccccaacaccggucggguccuguucgaggcgaagcuguacgccaauggcuuccucaccgucaaccucggugccucggaccaggcgacccuacccguggacgggauauuuaaauuuguuuccuggguuucuuuuuauuaccaguugcggccugugggaaaugcuaguguuggccgccgccuuuaa

SEQ ID NO: 8587 - RNA, 1551 nt, Artificial Sequence
  VP1__Norovirus_and/or_Norovirus-like__AY126474
augaagaugacugacagagauaccauugauucugcuccggcgcucggacaaguccucccuccugaggucgaggcguccguccccguugagccaacagccggcgccccugucgccgcccccacugcugggcagguuaacccaauugacccauggauuuuugcuaauuuugugcaagccccucaaggcgaauuuacuauauccccuaauaacaauccuggugagauucuguuugaauuggaacuuggcccugauuugaaccccuauuuggcccaccuucgucgcauguauaauggauggaccggauccaugcgcgugcgaguucuccuggcgggcaacgccuucucggcgggcaaaguggugguguuuuguguccccccuggguuugauacuuccuaccugaccccgucucaggcuacccaguuuccucaugugcugauugacgugcgcgccccagaaccuguugagaugccucuugaagauguucgcaacauucuuuuccaccaggggccugauucgcgcaugaggcucauggggaugcucuacaccccuuugcgugccaacuccggcgcggaccccuuuguuguuaccggccguguccucaccugcccuagccccaacuuuuccuuuuucuuucugguuccccccaccguugaggaaagggagcccccuuuuacuuuaccaaauuugccugucaacaaucuuucgcauucccggguuauggagcccauagcccagaugaugagcucucgcaacuuuccagccucaguccaauuccaaaauggccgcugcacccuuuccggcgaccuccugggcacaaccccaucgucucccgccgaccugggcgcuuuuguaggccugauugccgagcccgguucccggguuguugagcugucucagcccaaucaggaggauuuucaugcugggucugccccugcuccuuuuggcuuuccagauuuuuccgaaugcucucugaccuuugugguggccagcgcgacgaccguuggggagcgcacugugaacacccguagucuucaaaauuuuacucccgcucuugggcacaucacauuugaugaggaggcucccgcugaucuguuucgggcccaucuccggaaccuuugggauccgacugagcacucguucuggaggaucccggacuaccgggccgaugugcuugguucugaguuugcccccucugucucugccccugguguuggugaaacccuucucuucuuuaugugcaaugucccucguuuaaauggugcuaauccuggucuuugccccugccugcuuccccaggaauggauuacccauuuuguuucugagcgugccgcccuucagagugauguggcacuuuuaaauuauguuaaucccaauaccggucggguucuguuugagugcaagcuguaugcuaacggcuuccucaccgucaaccuuggcgccucggaccaggcgacccugccgguggaugggauauucaaauuuguuucuuggguuucuuuuuacuaucaguugcggccugugggaaaugcuaguguuggccgccgucuuuaa

SEQ ID NO: 8588 - RNA, 1551 nt, Artificial Sequence
  VP1__Norovirus_and/or_Norovirus-like__JX145650
augaagaugacugacagagacauuguugauucugcuccggcgcucggacaaguccucccucccgagguugaggcguccguccccguugagccaacagcuggcgcccccgucgccgcuuccacugcugggcggguuaauccaauugauccuuggauuuuugcuaauuuugugcaagccccccagggagaguuuacuauauccccaaauaauaacccuggugagauuuuauuugaauuggaacuuggcccugaucugaauccuuauuuggcccaccuucgucgcauguauaauggguggaccggauccaugcgcgugcgaguccuccuggcagggaacgccuuuucggcgggcaagguggugguguuuuguguccccccuggauuugacacuucuuaucugacccccucccaggccacccaguuuccccaugugcugaucgaugugcgcgcuccagagccugucgauaugccccuugaagauguucguaacauccuuuuucaucaggggcccgauucacgcaugaggcugauggggaugcuguauaccccccugcgcgccaauuccggcgcggacccuuuuguugucaccggucguguccucacuugucccagccccaauuuuuccuucuucuuucugguuccccccaccguugaggagagggagccccccuucacuuugccaaauuugccugucaauagucuuucacauucccgggucauggaaccgauagcccaaaugaugagcucccguagcuuuccagcuucaguucaguuccagaauggccgcugcacccuuucuggcgaccuucuggguacgacuccaucauccccugccgaucugggcgcuuucgugggccugauugccgaaccugguucccgugucguugaauugucccagcccaaccaggaggauuuucaugcugggucugccccagcccccuuuggcuuuccagauuuuuccgaauguucugugacuuuugugguggcuagugcgacaaccgucggcgaacgcacugugaaugcccgcaacccccaaaauuuuacucccgcccucggacauaucacuuuugaugaggaggccccugccgacuuguuucgggcucgcuuccggaaucucugggagccaaccgagcacuccuucuggaggaucccagauuaucgagcugaugugcuugguucugauuuugccccuucuguuucagccccaggcguuggugaaacucuccuuuucuuuaugugcaauguuccucgccuuaauggcgcuaaucccaacccuugcccuugcuugcuuccccaggaguggauuacccauuucguuucugagcgcgccgcucuucagagcgauguggcgcuccucaauuauguuaaucccaacaccggccggguucuguuugaggccaagcuguaugcuaauggcuuucucaccgucaaccuuggcgccucggaccaggcgauccugcccguggacgggauauuuaaauuuguuucuuggguuucuuucuauuaccaguugcggcccgugggaaauauuaguguuggccgccgccuuuaa

SEQ ID NO: 8589 - RNA, 1548 nt, Artificial Sequence
  VP1__Norovirus_and/or_Norovirus-like__AY549161
augaagaugacugacagagacacuacugauuccgcuccggcgcucggacagguccucccuccagagguugaggcguccguccccguugagccaacugccggcgccccugucgccgccgccacugcugggcaagucaacccaauugacccauggauuuuugccaauuuuguucaagcuccccaaggggaguuuaccauaucccccaauaauaacccuggugagauucuuuuugagcuagagcucggcccagaccugaauccauaccuggcccaucuccgccgcauguacaacggcuggaccggguccaugcgugugcggguucuuuuggcggggaacgccuuuucagcuggcaaggugguuguguuuugcguccccccuggguuugacgccucuuacuugacuccaucgcaagccacccaguucccccacgugcugauugacgugcgcgcuccagagccaguugagaugccuuuggaggacguccgcaacauccuguuccaccaggggccugauucucggaugaagcucauggggaugcuguacacccccuugcgcgccaacuccggcgcggaccccuucguugucacaggccgaguccucacuugccccaguccuaauuucucuuucuucuuucuaguuccccccacuguugaggagagagaggcaccauuuacccuaccaaauuugcccguuaauagccugucucauucccgguauguggggccaauaaugcaaaugaugaguucccgcaccuuuccagccucaguucaauuucagaauggucgcugcacccuuucuggugaccuuuugggcacgacuccaucaucuuccgccgaucugggcgcuuuuguuggcuugauugccgaggcugguucucggguuguugaguugucccagcccaaucaggaggauuuccacgcuggguccgccccugccccucuugguuuuccagauuuuuccgauuguucccucacguuugugguggcuagccucacgaccguuggggagcgcacugugaaugcccggagccuccagaacuuuacucccgcucuuggccauguuacuuuugaugaggaggccccagccgauuuguuccgggcucgccuccggaaccucugggauccaacggagcauuccgucuggagaaucccggauuaucgggcugacgugcuugguucugaauuugccccuucgguuuccgcuccaggcgugggugaaacccucuuguucuuuaugugcaauguuccccaucagaccggugcuaaccccaauccuuguccuugcuugcucccucaggaguggauuacccacuuuguuucugaacgugccgcccugcaaagugagguggcgcugcugaauuaugucaaucccaacaccggccggguucucuuugagugcaagcuguacgccaacggcuuccugacuguuaaucucggagccucggaccaggugucucugccuguggaugggauauuuaaauuuguuuccuggguuucuuuuuauuaucaguugcggccugugggaaauacugguguuggccgccguuaa

SEQ ID NO: 8590 - RNA, 1548 nt, Artificial Sequence
  VP1__Norovirus_and/or_Norovirus-like__AY549164
augaagaugacugacagagacgcuguugauuccgcuccggcgcucggacaaguccucccuccugaggucgaggcguccguccccguugagccaacagccggcgcucccgucgccgcccccaccgcugggcagguuaacccaauugauccauggauuuuugcuaauuuugugcaggccccccagggagaguuuaccauauccccaaauaauaauccuggugagauuuuguuugaauuagaacuuggcccugauuugaaucccuauuuggcccaccuucgccgcauguauaauggauggaccggauccaugcgcgugcggguucuccuugcggggaacgccuuuucggcaggcaagguggugguguuuugugucccuccuggguuugauaccuccuauuugaccccaucccaggcuacccaguucccccaugugcugauugacgugcgugccccagagccuguugagaugccccuugaagauguccgcaacauccuuuuccaccaggggcccgacucgcguaugaggcucauggggaugcucuacacccccuugcgugccaacuccggugcagacccuuuugucgucaccggccgcguucuuacuugccccagcccuaauuucuccuucuucuuucuggguccucccacuguugaggaaagggagccucucuucacuuugccaaauuugccuguuaacaaucuuucacauucucggguuauggagccgauagcccagaugaugaguucucguaguuuuccggccucaguccaguuucagaacggccgcugcacucuuucuggugaucuuuuggguacgacuccaucaucccccgcugauuugggugccuuuguaggccugagagcugagccuggaucccggguugucgaacugucccagcccaaccaggaagauuuccaugcuggguccgcuccugcccccuuuggcuuuccagauuuuuccgauugcucugugacuuuugugguggcuaaugcaacaacuguucaggagugcaccgugaacacccgcaacccacagaauuucacccccgcccuugggcacauuaccuuugaugaggaggccccugcugauuuguuucgggcccgcuuccggaaucucugggacccaacugagcauucguucuggaggauuccggauuaucgggcugaagugcuuggcucugauuuugcuccuucuguuucagccccggguguuggugagacccuucuuuucuuuaugugcaaugucccucguucgaacggugcuaaucccaauccuugccccugcuugcucccccaagaauggauuacccacuuuguuucugagcgcgccgcccuucagagcgacguggcacuuuugaauuauguuaaucccaauaccggccggguccuguuugaggccaaauuguacgccaacgguuuucugaccgucaaucuuggcgccucggaccaggcaacccuaccuguggaugggauauuuaaauuuguuuccuggguuucuuucuauuaccaguugcggccugugggaaauacuaguguuggccgucgcuaa

SEQ ID NO: 8591 - RNA, 1548 nt, Artificial Sequence
  VP1__Norovirus_and/or_Norovirus-like__AY126476
augaagaugacugacagagacacuguugacuccgcuccggcgcucggacaaguccucccuccugagguugaggcguccguccccgucgagccaacagccggcgcucccgucgccgcccccaccgcugggcagguuaacccaauugacccauggauuuuugccaauuucgugcaggccccccagggagaguuuaccauauccccaaauaauaauccuggugagauuuuguuugaauuagagcuuggcccugauuugaaccccuauuuggcccaccuucgccgcauguauaauggauggaccggauccaugcgcgugcggguccuucuugcggggaacgccuuuucggcaggcaagguggugguguuuuguguuccuccuggguuugacaccucuuauuugaccccaucccaggcuacccaguucccccaugugcugauugaugugcgcgccccagagccuguugagaugccccuugaagacguccgcaacauccuuuuccaccaggggccugacucgcguaugaggcucauggggaugcucuacacccccuugcgcgccaauuccggcgcagacccuuuuguugucaccggccguguccucacuugcccuaguccuaauuucuccuuuuucuuuuugguuccucccacuguugaggaaagggagccucccuuuacuuugccaaauuugccuguuaauaaucuuucacauucucggguuauggagccgauagcccagaugaugaguucucgcaguuuuccagcuucaguccaguuccagaacggucgcugcacucuuucuggugaccuucuggguacgacuccaucaucccccgcugauuugggugccuuuguaggccugagagcugagccuggaucucggguuguugaauugucccagcccaaccaggaagauuuccaugcuggguccgcuccugcccccuuuggcuuuccagauuuuucugacugcucugugacuuuugugguggcuagugcaacaacuguucaggaguguacugugaacacccgcaaccuacaaaauuuuacccccgcccuugggcacaucaccuuugaugaggaggccccugccgacuuguuucgggcccgcuuccggaaucucugggacccaacugagcauucgcucuggaggauuccggacuaucgagcugaagugcuugguucugauuuugcuccuucuguuucagccccggguguuggugagacccuucuuuucuuuaugugcaaugucccucguucgaauggugcuaaccccaauccuugccccugcuugcucccucaagaauggauuacccauuuuguuucugagcgcgccgcccuucagagcgacguggcacuuuugaauuauguuaaucccaacaccggccgagucuuguuugaggccaaauuguaugccagcggcuuccucaccgucaaucuuggcgccucggaccaggcaacccugccuguggaugggauauuuaaauuuguuuccuggguuucuuuuuauuaucaguugcggccugugggaaauacuagcguuggccgccgcuaa

SEQ ID NO: 8592 - RNA, 1548 nt, Artificial Sequence
  VP1__Norovirus_and/or_Norovirus-like__EU794905
augaagaugacugacagagacacuauugauucugcuccggcgcucggacagguccuccccccugagguugaggcguccguacccguugagccaacagccggcgccccugucgccgcccccacugcugggcaggucaauccaauugacccauggauuuuugccaauuuugugcaagccccucaaggugaauuuaccauaucucccaauaauaauccuggugagauuuuguuugaauuggaacuuggcccugaucugaaccccuauuuggcccaccuccgccgcauguacaauggauggaccggguccaugcgcgugcgaguccuucuagcgggcaacgccuuuucggcgggcaagguggugguguuuuguguuccccccggguuugacacuuccuaccugacuccaucucaggccacccaguucccucacgugcuaauugaugugcgugccccagaaccaguugagaugccccuugaagacguucgcaacauucuuuuccaucaggggccugauucgcgcaugagacucauggggaugcucuacaccccucugcgugccaauuccggugcggaucccuuuguugucaccggccguguucucaccugccccagccccaauuucuccuuuuucuuuuuaguuccccccacuguugaggaaagggagacuccuuucacuuuaccaaaucuaccugugaauagucuuucacauucccgggcuauggaacccauagcccagaugaugagcucccgcaauuuuccagcuucgguucaguuucaaaauggucgcugcacccucuccggcgaucuuuugggcacaacuccaucgucucccgccgacgucggcaccuuugugggcuugaucgcugagcccggcucucacguuguugaauugucccagcccaaucaggaggauuuucaugcugggucugccccugcccccuuuggcuuuccagacuuuuccgacugcucuuugaccuuugugguggccagcgcgucgaccguuggggagcgcacugugaacacccguagcccccagaauuuuacccccgcccucgggcauauuacauuugaugaggaggccccugcugaucuguuucgggcccaucuccggaaccuuugggauccgaccgagcacucguucuggaggauuccggauuaccgggccgacgugcuugguggcgaguuugcccccucugucucugccccugguguuggugaaacccuucuuuucuuuauguguaaugucccucguucaaauggugcuaaucccaaucccugcccuugccugcucccucaggaauggauuacccauuuuguuucugagcgugccgcccuucagagugauguggcacuucuaaauuauauuaaucccaacaccggucggguuuuguuugagugcaagcuauaugcuaauggcuuccucaccguuaaccuuggcgccucagaccaggcgacccuaccgguggaugggauauuuaaguuuguuucuuggguuucuuuuuacuaucagcugcggccugugggaaauauugguguuggccgccguuaa

SEQ ID NO: 8593 - RNA, 1548 nt, Artificial Sequence
  VP1__Norovirus_and/or_Norovirus-like__EU794906
augaagaugacugacagagacacuauugauucugcuccggcgcucggacaaguccuccccccugagguugaggcguccguacccguugagccaacagccggcgccccugucgccgcccccacugcugggcaggucaacccaauugacccauggauuuuugccaauuuugugcaagcuccucaaggugaauuuaccauaucccccaauaauaauccuggugagauuuuguuugaauuggaacuuggcccugaucuaaauccuuauuuggcccaccuucgccgcauguacaauggauggaccggguccaugcgcgugcgaguccuucuagcgggcaacgccuuuucggcgggcaagguggugguguuuugugucccccccggguuugacacuuccuaccugacuccaucucaggccacccaguucccucacgugcuaauugaugugcgcgccccagaaccaguugagaugccccuugaagauguucgcaauauucuuuuccaucaggggccugauucacgcaugaggcucauggggaugcuuuacaccccucugcgugccaacucuggcgcggaccccuuuguugucaccggccguguccucaccugcccuagccccaauuuuuccuuuuucuuuuuaguuccccccacuguugaggaaagggagaccccuuuuacuuuaccaaauuugccugugaauagucuuucacauucccggguuauggagcccauagcccagaugaugagcucccgcaauuucccagcuucgguucaguuucaaaauggccgcugcacccucuccggcgaucucuugggcacaaccccaucgucucccgccgaccucggcaccuuugugggcuugaucgcugagccuggcucucauguugcugaauugucucagcccaaucaggaggauuuucaugcugggucugccccugccccuuuuggcuucccagauuuuucugaaugcucuuugaccuuugugguggccagcgcgucgaccguuggggagcguacugugaacacccguagccuccagaauuuuacccccgcccucgggcacauuacauuugaugaggaggcuccugcugauuuguuucgggcccaucuccggaaccuuugggacccgaccgagcacucguucuggaggauuccggacuaccgggccgacgugcuugguggugaguuugcccccucuguuuccgccccugguguuggcgaaacccuucuuuucuuuauguguaaugucccucguuuaaauggugcuaauccuaaucccugcccuugccugcucccucaggaguggauuacccauuuuguuucugagcgugccgcccuucagagugauguggcacuucuaaauuauauuaaccccaacaccggccggguuuuguuugagugcaagcuguauguuaauggcuuccucaccguuaaucuuggcgccucagaccaggcgacccuaccgguggaugggauauuuaaguuuguuucuuggguuucuuuuuauuaucaguugcggccugugggaaauauugguguuggccgccguuaa

SEQ ID NO: 8594 - RNA, 1548 nt, Artificial Sequence
  VP1__Norovirus_and/or_Norovirus-like__AY126475
augaagaugacugacagagacacugcugauccugcuccggcacucggacaaguccucccuccugagguugaggcguccguccccguugagccaacagccggcgcccccgucgccgcccccacugcugggcaagucaauccaauugacccauggaucuuugccaauuuugugcaagcuccccagggggaguucaccauaucccccaauaauaacccuggugagauuuuguuugaauuggaacuugguccugauuugaaucccuauuuggcccaucuucgucgcauguacaauggauggacuggauccaugcgcgugcgaguccuccuagcagggaaugccuuuucagcgggcaagguggugguguuuuguguuccuccuggguuugacacuuccuaccugacuccaucucaggccacucaguucccccaugugcugauugaugugcgcguuccagagccuguugagaugccucucgaggauguucgcaacauucuuuuucaccaagggccugauucacguaugaggcucauggggaugcuguacaccccccugcgugccaauuccggcgcggaucccuuuguugucaccggccgcguccucacuugccccaguccuaauuuuuccuuuuucuuucuggucccccccaccguugaggaaagggagccuccuuuuaccuugcccaauuuaccuguuaauaaucuuucacauucucggguuauggagccgauagcccagaugaugaguucucgcagcuuuccagccucaguucaguuucagaauggccgcugcacccuuucuggugaucuuuugggcacaaccccaucauccccugcugaccugggcgcuuuugucggccugauugcugagcccgggucacggguuguugaguuauuccaacccaaucaggaggauuuucaugcuggaucugcucccgcccccuuuggcuuuccagauuuuucugaguguuccgugaccuuugugguguccagugcgacgaccgucggggagcgcacugugaaugcucgcaaucaacagaauuuuacuccugcucuugggcauauuacuuuugaugaagaggccccugcugauuuguuucgcgcuuguuuccggaaccucugggagccaacugaacauucauucuggaggauuccggauuaucgagcugaugugcuugguucugauuuugcuccuucuguuucugccccagguguuggugagacucuucuuuucuuuaugugcaaugucccccgcuugaauggugucaaucccggccccugucccuguuugcuuccccaggaauggauuacucauuuuguuucugagcgcgccgcucuucagagcgauguggcgcuccugaauuaugucaaucccaacaccggccggguccuguucgaggcgaaguuguacgccaacggcuuccucaccgucaaccuuggugccucggaucaggcgacccugcccguggaugggauauuuaaauuuguuucuuggguuucuuucuacuaucaauugcggccugugggaaauacuaguguuggccgccgcuaa

SEQ ID NO: 8595 - RNA, 1548 nt, Artificial Sequence
  VP1__Norovirus_and/or_Norovirus-like__AF542084
augaagaugacugacagagacacuguugauuccgcuccggcgcucggacaaguccucccucccgagguugaggcguccguccccguugagccaacagccggcgcucccgucgccgcccccaccgcugggcagguuaacccaauugacccauggauuuuugccaauuuugugcaggccccccagggagaguuuaccauauccccaaauaauaauccuggugagauucuguuugaauuagagcuugguccugauuugaaucccuauuuggcccaccuucgccgcauguacaauggauggaccggauccaugcgugugcggguccuucuugcggggaacgccuuuucggcaggcaaggugguggucuuuugugucccuccuggguuugauaccuccuacuugaccccaucccaggcuacccaguucccccaugugcugauugaugugcgcgccccagagccuguugagaugccccuugaagauguccgcaacauccuuuuccaccaggggcccgauucgcgaaugaggcucauggggaugcuuuacacccccuugcgugccaauuccggugcagacccuuuugucgucaccggccguguucuuacuugcccuagcccuaauuucuccuucuucuuuuugguuccuccuacugucgaggaaagggagccucucuuuacucugccaaauuugccuguuaauaaccuuucacacucucggguuauggagccgauagcccagaugaugaguucucgcaauuuuccagccucaguucaguuccagaacggccgcuguacucuuucuggugaucuucuggguacgacuccaucaucccccgcugauuugggugccuuuguaggccugagagcugagccuggaucccggguuguugaauugucccagcccaaccaggaagauuuccaugcuggguccgcuccugccccccuuggcuuuccagauuuuuccgauugcucugugacuuuugugguggccaaugcaacaacuguucaggaguguaccgugaacacccgcaacccgcagaauuuuacccccgcccuugggcacaucacuuuugaugaggaggccccugccgauuuguuucgggcccacuuccggaaucucugggacccaacugagcauucguucuggaggauuccggacuaucgagcugaagugcuugguucugauuuugcuccuucuguuucagccccggguguuggugagacccuucucuucuuuaugugcaaugucccucguucgaauggugcuaaccccaauccuugcccuugcuugcucccccaagaauggaucacccauuuuguuucugagcgcgccgcccuccagagcgacguggcacuuuugaauuaugucaaucccaacaccggccggguucuguuugaggccaaauuguaugccaacggcuuucuuaccgucaaucuuggcgccucggaccaggcaacccuaccuguggaugggauauuuaaauuuguuuccuggguuucuuucuacuaucaguugcggccugugggaaauacuaguguuggccgccgcuaa

SEQ ID NO: 8596 - RNA, 1536 nt, Artificial Sequence
  VP1__Norovirus_and/or_Norovirus-like__KC695807
auggcucuggagcccguuguuggugccgccauugcggcaccuguagcgggccaacaaaauguaauugaccccuggauuagaaacaauuuuguacaagccccugguggagaguucacaguguccccuagaaacgcuccaggugaaauacuauggagcgcgcccuuaggcccugaucuaaaucccuaccuaucccauuuggccagaauguauaaugguuaugcagguggcuuugaagugcagguaauucucgcggggaacgcguucaccgcugggaaggucauauuugcagcagucccaccaaauuuuccaacugaaggcuugagccccagccaagucacuauguucccccauauaguaguagauguuaggcaacuagaaccuguguugauucccuuacccgauguuaggaauaauuucuaucauuacaaucaaucaaaugaucccaccauuaagcugauagcaauguuguauacaccacuuagggcuaauaaugcuggggacgaugucuucacaguuucuugccgaguucucacgagaccaucccccgauuuugauuucauauuucuagugccacccacaguugagucuagaacuaaaccauucucugucccaguuuuaacuguugaggagaugaccaauucaagauuccccauuccuuuggaaaaguuguucacgggucccagcagugccuuuguuguucaaccacaaaacgguaggugcacgacugauggcgugcuccuaggcaccacccaauugucuccugucaacaucugcaccuucagaggggaugucacccacaucacagguagucguaacuacacaaugaauuuggcuucucaaaauuggaacaauuaugacccaacagaagaaaucccagccccucuaggagcuccagauuuuguggggaagauucaaggcaugcucacccaaaccacaagggcagauggcucaacacgcggccacaaagcuacaguguacacugggagcgccgacuuugcuccaaaacugggcagaguccaauuugaaacugacacagaccaugauuuugaagcuaaccaaaauacaaaguucaccccagucggugucauccaagaugguagcaccacccaccgaaaugaaccccaacagugggugcucccaaguuacucaggcagaaauacucauaauguucaucuggcccccgcuguagcccccacuuuuccgggugagcaacuucucuucuuuagauccaccaugcccggauguagcggguaccccaacauggauuuggacugucugcuuccccaggaaugggugcaguacuucuaccaagaggcagccccagcacaaucugauguggcucugcuaagauuugugaauccggacacagguaggguuuuguuugaguguaagcuucauaaaucaggcuauguuacaguggcucacacuggccaacaugauuugguuaucccccccaaugguuauuuuagguuugauuccugggucaaccaguucuacacgcuugcccccaugggaaauggaacggggcguagauaa

SEQ ID NO: 8597 - RNA, 807 nt, Artificial Sequence
  VP2_capsid_protein__Norovirus__AGL98415
auggcuggagcuuucuucgcuggauuggcaucugauguccucgguucuggucuugguucucuaaucaaugcuggagcuggggccauaaaccaaaagguggaauuugagaauaauagaaaauuacaacaagcuuccuuucaauuuagcaguaauuugcaacaggcuucuuuucaacaugacaaagaaaugcuccaggcucaaauugaugcuacccacaaauugcaacaagguuuaaugcagaucaaacaggcagugcuccuagaggguggguuuuccgcggcagacgccgcucgcggggcgaucaaugcgcccaugacaaaagcccuggauuggaguggaacuagguacugggcucccgaggccagagucacaacauacaaugcaggccacuuuucccccucucagcccucgagagcaccgucugggaggaucaacuccgggacucccacuccugcacggaacucccuuaacucaccugcuacaucuucuguugcuacaucugugcacucuaaucaaacugcuucaacgagaauugguucuucagcuggcucuggaaccagugucucgagucucccgucgacuucaagaaccaggaacugggucgaggaucaaaacaggagcgugucacccuucaugaggggggcgcucaacacaucauuuguaacuccuccaucuagcagauccucuaaccagagcacagucucaaccgugcccaaagaaauuuuggacuccuggacuggcgcuuucaacacgcgcaggcagccacucuucgcacacauccguaggcgaggggagucacggguuuaa

SEQ ID NO: 8598 - RNA, 792 nt, Artificial Sequence
  VP2_capsid_protein__Norovirus__AGL98417
auggcuggggcuuucuuugcuggauuagcgucugacguacucggcaccggccuugguucucuaaucggcgccggggcuggcgccaucaaucagaaaguggaauaugagaauaacagaaaauugcagcaggcuuccuuccaauuuaguagugauuuacagcaagcuucuuuccaacaugauaaggauaugcuccaagcucagauuaaggcaacccaaaaauugcaacaugaucuuaugagagucaagcaggcagugcuacuagagggaggcuuuucccccaccgacgcugcacguggugcaaucaacgcaccuaugacaaaggucuuggacuggagcgggacucgcuacugggcuccuggggcuaggguuacaacaucuaacgcaggccaauucucuuucucacaacccauccgggagccaucuggcaggaccgcccccgcccgaagucccgccaaucgagcuucuaguguaucugcacccucuucuacacuuucuaaucaaacaaccucaacgagacuuggcacuucagcagguucuggugccagugucucgggcucuucaucggccucgaggguuaggagcuggguagagggccaaaacaggagccuuucgcccuucauggacggggcgcuccacacuucauuugucacacccccaucaaguaaguccucuagccaaggcacagucucaaccgugcccaaagaaguuuuggacuccuggacuggugcuuucaacacgcacagacagccgcucuucgcccacgugcgcagacaaggggagucacgaguuuaa

SEQ ID NO: 8599 - RNA, 648 nt, Artificial Sequence
  capsid_protein_VP2__Norovirus__AFI08232
auggcucaagcugucuuaggagcaauugcagccacagccgcuggcagcgcgguuggggcaggcauucaggcuggcacugaagcugcacugcaacaucagcgcuuucaacaagacuugacucuacaaaguaacacauucaaacaugauaaggagauguuggcuaugcagguggaggcuucuacuucuuuauuacagaauagcuugaacacucgcuauaacuuguugacccaggcaggucugacuucugcagaugccgccagagcaguggcgggggcccccgucacucgugugguggacuggaauggcacucgcaucgccgcuccacuaucaacugccaccacucuccgcucuggaggauuuaugucuauaccggucauguauaggggugcaaaaacagaacagcagaaauugacaggcuucucaaaccccaauuacgagacugguucaucugugucgcgcacaucgcaauggguuuccucacaaaacucaaugcggucuagcguagcaccauuccacccagaugcacuuaggacaacuugggucacaccgccugguucgucuucuacaucuacuguuucuucagcuucaucuauaccuagauucuuuaauacugaaagauuacccuuguucgcaaacaauaagagguga

SEQ ID NO: 8600 - RNA, 807 nt, Artificial Sequence
  capsid_protein_VP2__Norovirus__AFI08235
auggcuggagcuuucuuugcuggauuggcaucugauguccuuggcucuggacuuggcucccugaucaaugcuggggcuggggcuaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaaggcuuuggacuggagcggaacaagguacugggccccugaugcuaggacuacaacauacaaugcaggccgcuuuuccaccccucaaccuucgggggcgcugccaggaagaaucaaucccaggacuccuacccccgcucggggcuccuccagcacaucuucuaaugcuucuacugcuacuucuauacauucaaaucaaaccguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuugaacuccuggacuggcgcuuucaacacgcgcaggcagccucucuucgcucacauucguaggcaaggggagucacggguguaa

SEQ ID NO: 8601 - RNA, 807 nt, Artificial Sequence
  capsid_protein_VP2__Norovirus__AFI08238
auggcuggagcuuucuuugcuggacuggcaucugauguccuuggcucuggacuugguucccuaaucaaugcuggggcuggggcuaucaaccaaaagauugauuuugaaaauaauagaaaauugcagcaagcuuccuuccaguuuagcaguaaucuucaacaggcuuccuuucaacacgauaaagagaugcuccaagcacaaaucgaggccacuaaaaaguugcaacaggaaaugaugaaagucaaacaggcaaugcuccuagaagguggauucucugaaacagaugcagcccguggggcaaucaacgcccccaugacaaaaguuuuggacuggagcggaacaagguacugggccccugaugcuaggacuacaacauacaaugcaggccgcuuuuccaccccucaaccuucggggacgcugccaggaagaaucaaucccaggacuccuacccccgcucggggcuccuccaguacgucuucuaaugcuucuacugcuacuucuauacauucaaaucaaacuguuucaacgagacuugguucuacagcugguucuggugccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccugggcuggcgcuuucaacacgcgcaggcagccucucuucgcucacauucguaggcgaggggagucacggguguaa

SEQ ID NO: 8602 - RNA, 807 nt, Artificial Sequence
  capsid_protein_VP2__Norovirus__AFI08241
auggcuggagcuuucuuugcuggauuggcaucugauguccuuggcucuggacuugguucccuaaucaaugcuggggcuggggcuaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggacuacaacauacaaugcgggccgcuuuuccaccccucaaccuucggggacgcugccaggaagaaccaaucccaggacuccuacccccgcucggggcuccucuagcgcaucuucuaaugcuucuacugcuacuucuauacuuucaaaucaaacugcuucaacgagacuugguucuacagcugguucugguaccaaugucucgagucucccgucaacugcaaggacuaggaguuggguugaggaucaaaacagaaauuugucaccuuucaugaggggggcucacaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8603 - RNA, 807 nt, Artificial Sequence
  capsid_protein_VP2__Norovirus__AFI08244
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacacacaaugcaggccgcuuuuccaccccccaaccuucggggacgcugccaggaagaaucaaucccaggacuccuacccccgcucggggcuccuccaacacaucuucuaaugcuucuacugcuacuucuauacauucaaaucaaacuguuucaacgagacuugguucuacagcugguucugguacuaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaauacgcgcaggcagccccucuucgcucacauucguaggcgaggggagucacggguguaa

SEQ ID NO: 8604 - RNA, 807 nt, Artificial Sequence
  capsid_protein_VP2__Norovirus__AFJ38520
auggcuggaccuuucuuugcuggauuggcaucugauguccucgguucuggacuugguucucuaaucaaugcuggagcuggagccaucaaucaaaaaguugaauuugaaaauaauagaaaauugcaacaagcuucuuuucaauucaguaguaaucugcaacaggcuuccuuccaacaugauaaggagaugcuccaagcacaaauugaggcuacucaaaaauugcaacaagguuugaugaagguuaaacaggcagugcuccuagaggguggguuuuccacaacagaugcggcccguggggcaaucaacgcccccaugacaaaggcucuggacuggagcggaacaagguacugggccccugaugccagggccacaacauacaaugcaggccgcuucuccaccccucagccuuugggggcauuaccuggaagaaucaauccuaggguuccugcaccugcucggagcucccccaguucacuuuccaaugcuccuacugcuacuucuguguauuccaaucaaacuguuucuacgagacuagguucuucagcugguucuggugccggugucucgagucucccgucaacugcaaggacuaggagcuggguugaggaccaaaacagaaauuugucgccuuucaugaggggggcucucaacacaucauuugucaccccuccaucuaguagauccuccaaccaaggcacagucucaaccgugccuaaagagauuuuggacuccuggacuggcgcuuuuaacacgcgcaggcagccucucuucgcacacauucguaagcgaggggagucacggguguaa

SEQ ID NO: 8605 - RNA, 765 nt, Artificial Sequence
  capsid_protein_VP2__Norovirus__AFX71657
auggcuggagccuuuauagcaggauuggcuggugacaugcucacaaguacugugggaucuuuaguuaaugcaggggcuagugcuaucaaucaaaaaguugauuuugaaaauaauaaauauuuacaaaaugcaucuuuuaaucaugauaaggagauguuaaaugcacaaauugaggcaacaaagaggcuacaggcugacaugauugcuaucaaacaaggggucuugaccgcuggcggcuuuucccccacugaugcagcccguggggcaauuaaugcccccauaacaagaguuuuggacuggaguggaacgagguacugggcaccaaacgccaccuccacaaccucaaugucagguggcuucacaagccaaacuguacacagaaccacaccaaauuuuaaaacgaaccaggcccccaaguccacacccagcagugggucuucagugagaucaaacucaacccaacucacuagcuugagcucacacucauccgggucgucucgauccagcgggucuacgguuguuagcucauugccaucuuccaacaggacuagggauugggucaaucaacagaauuucaauuuggaaccacacaugccuggaucucucaggacagcuuuugucacuccaccaucuaguacagccucuaauucagacacggucucaaccgugcccaaaaguguuuuggacuccuggacaucugcguuuaauacgcgcagacagccgcuauucgcacaccuucgcagaaggggggagucaaauguuuag

SEQ ID NO: 8606 - RNA, 780 nt, Artificial Sequence
  capsid_protein_VP2__Norovirus__AFX71660
auggcuggagcuuucguagcuggucucgcgggggaugugcucagcaaugggcucaguucacuaauuaaugcaggugcuaaugcaauaaaucagagagcagaauuugauuuuaaccagagauuacagcaaaauucuuuuaaucaugauaaggagauguugcaggcucagauucaggcaacuaagcagcugcaggcagacaugauggcuauaaagcaggggguucugaccgcuggcggcuuuuccccuacugaugcagccagaggcgcugugaacgcgcccaugacacaggcgcuggauuggaauggcacaagguauugggcaccaggcuccaugaggacuacauccuacucuggcagguucacaucgaccgccccggcaaggcaggccgacuuucaacacacucaaaaucggccuucgaguggcucuucuguguccucuuauaccacucaaucuucaagaccaacucuaaccacaaccacaggguccucacacgguacaaccucauccaauucgacccguagcacaaaccuuucccagucgacggucucuagggcuaccucuaggacuagugaguggguuagagaucaaaauaggaauuuggaacccuacaugcauggugccuuacagacagccuuugucaccccaccuuccagcagggcaucugacgggacagucucaaccguccccaaagguguuuuggacuccuggacaccugcguucaacacccgcaggcagccgcuuuuugcacaccuccguaagaggggggagucacggguguaa

SEQ ID NO: 8607 - RNA, 780 nt, Artificial Sequence
  capsid_protein_VP2__Norovirus__AFX71666
auggcuggagccuucuucgcaggguuagcaggugaugucgugucgaacggcaucggaucccuuauuaaugcaggugccaaugcaguuaaucaaaagguugaguaugauuuuaauaagcaacuucagauggcaucauuuaaacaugacaaggagaugcuacaaucacaggugcuggcaaccaaacaacugcagcaggagaugaugaacauaaggcaggggguguugaccgcuggcggcuucuccccugcggaugcugcuagaggggcuguuaaugcuccaaugacgaagauacuggacuggaauggcacaagauauugggcaccaaacagcaugaaaaccacaagcuauucaggacaguucucuaguagcccuguacacagaccuccugcugcuccccagcauacugcuccaccaaaaaguaaguugcaaggugauucuguuaguguauauaguucucccucuacuguuucuucacaaucaacccauucaacagugcugucugcaggaacugggucauccagguccaccuccacguccacagcagccuccaccuugucucggaccagugacuggguuaggggucagaaugaaaggcuuagcccguuuauggauggugcccuccaaacuaccuuugucacaccaccaucgagcaaagcuucaucaaaugggacggucucaaccguacccaaagcuguuuuggacuccuggacuccuacguucaauacgcauaggcagccucucuucgcccauuugcguaggcgaggggagucacaaauuuag

SEQ ID NO: 8608 - RNA, 807 nt, Artificial Sequence
  capsid_protein_VP2__Norovirus__AFX71669
auggcuggagcuuucuuugcuggauuggcaucugacguccuuggcucuggacuugguucccuaaucaaugcuggggcuggggucaucaaccaaaaaguugauuuugaaaauaacagaaaauugcaacaagcuuccuuccaguuuagcagcaaucaacaacaggcuuccuuccaacaugacaaagagaugcuccaagcacaaauugaggccaccaaaaaguugcaacaggaaaugaugagaguuaaacaagcaaugcuccuagaggguggauucucugagacagaugcggcccguggggcaaucaacgcccccaugacaaaagcucuggacuggagcgggacaagguacugggcucccgaugcuaggacuacaacauacaaugcaggccgcuuuuccaccccucaacccucgggggcaucaccaggaagagcuaaucuuagggcuaccguccccgcccgggguuccuccagcacgucuucuaacucuucuauugcuacuucuguguauucaaaucaaaccaccucaacgagacuugguucuacagcugguucugguaccagugucucgagccucccgucaacugcaaggaccaugagcuggguugaggaucaaaauaggaauuugucaccuuucaugaggggggcccacaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8609 - RNA, 807 nt, Artificial Sequence
  capsid_protein_VP2__Norovirus__AFX81122
auggcuggagcuuucuuugcuggauuggcaucugauguccuuggcucuggacuugguucccuaaucaaugcuggggcuggggcuaucaaccaaaagauugauuuugaaaauaauagaaaauugcagcaagcuucuuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggacuacaacauacaaugcaggccgcuuuuccaccccucaaccuucggggacgcugccaggaagaaccaaucccaggacuccuacccccgcucggggcuccuccagcacaucuucuaaugcuucuacugcuacuucuauacuuucaaaucaaacugcuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8610 - RNA, 807 nt, Artificial Sequence
  capsid_protein_VP2__Norovirus__AFX81125
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaauaaugaaagccaaacaggcaaugcuccuagaagguggauucucugaaacagaugcagcccguggggcaaucaacgcccccaugacaaagguuuuggacuggagcggaacaagguauugggccccugaugcuaggaccgcaacauacaaugcaggccgcuuuuccaccccucaaccuucggggacgcugccaggaagaaucaaucccaggacuccuacccccgcucggggcuccuccagcacaucuucuaaugcuucuacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8611 - RNA, 807 nt, Artificial Sequence
  capsid_protein_VP2__Norovirus__AFX81131
auggcuggagcuuucuuugcuggacuggcaucugauguccuuggcucuggacuugguucccuaaucaaugcuggggcuggggcuaucaaccaaaagauugauuuugaaaauaauagaaaauugcagcaagcuuccuuccaguuuagcaguaaucuucaacaggcuuccuuucaacacgauaaagagaugcuccaagcacaaaucgaggccacuaaaaaguugcaacaggaagugaugaaagucaaacaggcaaugcuccuagaagguggauucucugaaacagaugcagcccguggggcaaucaacgcccccaugacaaaaguuuuggacuggagcggaacaagguacugggccccugaugcuaggacuacaacauacaaugcaggccgcuuuuccaccccucaaccuucggggacgcugccaggaagaaucaaucccaggacuccuacccccgcucggggcuccuccaguacaucuucuaaugcuucuacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8612 - RNA, 807 nt, Artificial Sequence
  capsid_protein_VP2__Norovirus__AFX81134
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacucccacccccgcucggggcuccuccagcacaucuucuaaugcuucuacugcuacuucuauacauucaaaucagacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8613 - RNA, 807 nt, Artificial Sequence
  capsid_protein_VP2__Norovirus__AFX81137
auggcuggagcuuucuuugcuggacuggcaucugauguccuuggcucuggacuugguucccuaaucaaugcuggggcuggggcuaucaaccaaaagauugauuuugaaaauaauagaaaauugcagcaagcuuccuuccaguuuagcaguaaucuucaacaggcuuccuuucaacacgauaaagagaugcuccaagcacaaaucgaggccacuaaaaaguugcaacaggaaaugaugaaagucaaacaggcaaugcuccuagaagguggauucucugaaacagacgcagcccguggggcaaucaacgcccccaugacaaaaguuuuggacuggagcggaacaagguacugggccccugaugcuaggacuacaacauacaaugcaggccgcuuuuccaccccucaaccuucggggacgcugccaggaagaaucaaucccaggacuccuacccccgcccggggcuccuccaguacaucuucuaaugcuucuacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8614 - RNA, 807 nt, Artificial Sequence
  capsid_protein_VP2__Norovirus__AFX81140
auggcuggagcuuucuuugcuggauuggcaucugauguccuugguucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuagugcuucuacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8615 - RNA, 807 nt, Artificial Sequence
  capsid_protein_VP2__Norovirus__AFX81143
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguauugggccccugaugcuaggaccacgacauacaaugcaggccgcuuuuccaccccucaaccuucggggacgcugccaggaagaaucaaucccaggaucccuacccccgcucggggcuccuccagcacaucuucuaaugcuucuacugcuacuucuauauauucaaaucaaacuguuucaacgagacuugguucuacagcugguucugguaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8616 - RNA, 807 nt, Artificial Sequence
  capsid_protein_VP2__Norovirus__AFX81149
auggcuggagcuuucuuugcuggacuggcaucugauguccuuggcucuggacuugguucccuaaucaaugcuggggcuggggcuaucaaccaaaagauugauuuugaaaauaauagaaaauugcagcaagcuuccuuccaguuuagcaguaaucuucaacaggcuuccuuucaacacgauaaagagaugcuccaagcacaaaucgaggccacuaaaaaguugcaacaggaaaugaugaaagucaaacaggcaaugcuccuagaagguggauucucugaaacagaugcagcccguggggcaaucaacgcccccaugacaaaaguuuuggacuggagcggaacaagguacugggccccugaugcuaggacuacaacauacaaugcaggccgcuuuuccaccccucaaccuucggggacgcugccaggaagaaucaaucccaggacuccuacccccgcucggggcuccuccaguacaucuucuaaugcuucuacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8617 - RNA, 807 nt, Artificial Sequence
  capsid_protein_VP2__Norovirus__AFX81152
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacagggaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuucuacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8618 - RNA, 807 nt, Artificial Sequence
  capsid_protein_VP2__Norovirus__AFX81155
auggcuggagcuuucuuugcuggacuggcaucugauguccuuggcucuggacuugguucccuaaucaaugcuggggcuggggcuaucaaccaaaagauugauuuugaaaauaauagaaaauugcagcaagcuuccuuccaguuuagcaguaaucuucaacaggcuuccuuucaacacgauaaagagaugcuccaagcacaaaucgaggccacuaaaaaguugcaacaggaaaugaugaaagucaaacaggcaaugcuccuagaagguggauucucugaaacagaugcagcccguggggcaaucaacgcccccaugacaaaaguuuuggacuggagcggaacaagguacugggccccugaugcuaggacuacaacauacaaugcaggccgcuuuuccaccccucaaccuucggggacgcugccaggaagaaucaaucccaggacuccuacccccgcucggggcuccuccaguacaucuucuaaugcuucuacugcuacuucuauacauucaaaucaaacuguuucaacgagacuugguucuacagcugguucugguaccaaugucccgagucucccgucaacugcaaggacuaggaguuggguugaggaucaaaacagaaauuugucaccuuucaugaggggggcucaaaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8619 - RNA, 807 nt, Artificial Sequence
  capsid_protein_VP2__Norovirus__AFX81158
auggcuggagcuuucuuugcuggacuggcaucugauguccuuggcucuggacuugguucccuaaucaaugcuggggcuggggcuaucaaccaaaagauugauuuugaaaauaauagaaaauugcagcaagcuuccuuccaguuuagcaguaaucuucaacaggcuuccuuucaacacgauaaagagaugcuccaagcacaaaucgaggccacuaaaaaguugcaacaggaaaugaugaaagucaaacaggcaaugcuccuagaagguggauucucugaaacagaugcagcccguggggcaaucaacgcccccaugacaaaaguuuuggacuggagcggaacaagguacugggccccugaugcuaggacuacaacauacaaugcaggccgcuuuuccaccccucaaccuucggggacgcugccaggaagaaucaaucccaggacucuuacccccgcucggggcuccuccaguacaucuucuaaugcuucuacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8620 - RNA, 807 nt, Artificial Sequence
  capsid_protein_VP2__Norovirus__AFX81164
auggcuggagcuuucuuugcuggauuggcaucugauguccuuggcucuggacuugguucccuaaucaacgcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuuccacugcuacuucuauauauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8621 - RNA, 807 nt, Artificial Sequence
  capsid_protein_VP2__Norovirus__AFX81173
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuuccacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8622 - RNA, 807 nt, Artificial Sequence; identical to SEQ ID NO: 8621
  capsid_protein_VP2__Norovirus__AFX81179

SEQ ID NO: 8623 - RNA, 807 nt, Artificial Sequence; identical to SEQ ID NO: 8620
  capsid_protein_VP2__Norovirus__AFX81182

SEQ ID NO: 8624 - RNA, 807 nt, Artificial Sequence
  capsid_protein_VP2__Norovirus__AFX81185
auggcuggagcuuucuuugcuggauuggcaucugauguccuuggcucuggacuugguucccuaaucaaugcuggggcuggggccaucaaccaaaagguugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuuccacugcuacuucuauacacucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8625 - RNA, 807 nt, Artificial Sequence
  capsid_protein_VP2__Norovirus__AFX81188
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaagaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuuccacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcccacauucguaggcgaggggagucacggguguaa

SEQ ID NO: 8626 - RNA, 807 nt, Artificial Sequence
  capsid_protein_VP2__Norovirus__AFX81191
auggcuggagcuuucuuugcuggacuggcaucugauguccuuggcucuggacuugguucccuaaucaaugcuggggcuggggcuaucaaccaaaagauugauuuugaaaauaauagaaaauugcagcaagcuuccuuccaguuuagcaguaaucuucaacaggcuuccuuucaacacgauaaagagaugcuccaagcacaaaucgaggccacuaaaaaguugcaacaggaaaugaugaaagucaaacaggcaaugcuccuagaagguggauucucugaaacagaugcagcccguggggcaaucaacgcccccaugacaaaaguuuuggacuggagcggaacaagguacugggccccugaugcuaggacuacaacauacaaugcaggccgcuuuuccaccccucaaccuucggggacgcugccaggaagaaucaaucccaggacuccuacccccgcucggggcuccuccaguacaucuucuaaugcuucuacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagucaaggcacagucucaaccgugccuaaagaaguuuuggacuccuggacuggcgcuuucaacacgcgcaggcagccucucuucgcucacauucguaggcgaggggagucacggguguaa

SEQ ID NO: 8627 - RNA, 807 nt, Artificial Sequence
  capsid_protein_VP2__Norovirus__AFX81194
auggcuggagcuuucuuugcuggauuggcaucugauguccuuggcucuggacuugguucccuaaucaacgcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagagucaaucccaggacuccuacccccgcucggggcuccuccagcacaucuucuaaugcuuccauugcuacuucuauauauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8628 - RNA, 807 nt, Artificial Sequence; identical to SEQ ID NO: 8621
  capsid_protein_VP2__Norovirus__AFX81197

SEQ ID NO: 8629 - RNA, 807 nt, Artificial Sequence
  capsid_protein_VP2__Norovirus__AFX81200
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaauguuucuacugccacuucuauauauuuaaaucaaacuguuucaacgagacuugguucuacagcugguucugguaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8630 - RNA, 807 nt, Artificial Sequence
  capsid_protein_VP2__Norovirus__AFX81203
auggcuggagcuuucuuugcuggauuggcaucugauguccuuggcucuggacuugguucccuaaucaacgcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaaggaucaaucccaggacuccuacccccgcucggggcuccuccagcacaucuucuaaugcuuccacugcuacuucuauauauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8631 - RNA, 807 nt, Artificial Sequence
  capsid_protein_VP2__Norovirus__AFX81206
auggcuggagcuuucuuugcuggauuggcaucugauguccuuggcucuggacuuaguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggagaugaugaaagucaaacaggcaaugcuccuagaagguggauucucugaaacagaugcagcccguggggcagucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuucuacugcuacuucuauauauucaaaucaaacuguuucaacgagacuugguucuacagcugguucuggcaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8632 - RNA, 807 nt, Artificial Sequence
  capsid_protein_VP2__Norovirus__AFX81209
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggagaugaugaaagucaagcaggcaaugcuccuagaagguggauucucugaaacagaugcagcccguggggcaaucaacgcucccaugacaaagguuuuggacuggagcggaacaagguacugggccccugacgcuaggaccacaacauacaaugcaggccgcuuuuccaccccucaaccuucggggacgcugccaggaagaaucaaucccaggacuccuacccccgcucggggcuccuccagcacaucuucuaaugcuucuacugcuacuucuauauauucaaaucaaacuguuucaacgagacuugguucuacagcugguucugguaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8633 - RNA, 807 nt, Artificial Sequence
  capsid_protein_VP2__Norovirus__AFX81212
auggcuggagcuuucuuugcuggacuggcaucugauguccuuggcucuggacuugguucccuaaucaaugcuggggcuggggcuaucaaccaaaagauugauuuugaaaauaauagaaaauugcagcaagcuuccuuccaguuuagcaguaaucuucaacaggcuuccuuucaacacgauaaagagaugcuccaagcacaaaucgaggccacuaaaaaguugcaacaggaaaugaugaaagucaaacaggcaaugcuccuagaagguggauucucugaaacagaugcagcccguggggcaaucaacgcccccaugacaaaaguuuuggacuggagcggaacaagguacugggccccugaugcuaggacuacaacauacaaugcgggccgcuuuuccaccccucaaccuucggggacgcugccaggaagaaucaaucccaggacuccuacccccgcucggggcuccuccaguacaacuucuaaugcuucuacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagucaaggcacagucucaaccgugccuaaagaaguuuuggacuccuggacuggcgcuuucaacacgcgcaggcagccucucuucgcucacauucguaggcgaggggagucacggguguaa

SEQ ID NO: 8634 - RNA, 807 nt, Artificial Sequence
  capsid_protein_VP2__Norovirus__AFX81215
auggcuggagcuuucuuugcuggauuggcaucugauguccuuggcucuggacuugguucccuaaucaacgcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcagucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcucccauugcuacuucuauauauucaaaucaaacuguuucaacgagacuugguucuacagcugguucugguaccaaugucucgagucucccgucaacugcaaggacuaggaguuggguugaggaucaaaacagaaauuuaucaccuuucaugaggggggcccauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8635 - RNA, 807 nt, Artificial Sequence
  capsid_protein_VP2__Norovirus__AFX81218
auggcuggagcuuucuuugcuggauuggcaucugauguccuuggcucuggacuugguucccuaaucaaugcuggggcuggggccaucaaccaaaagauugauuuugaaaauaauagaaaacugcagcaagcuuccuuccaguuuagcaguaaucuacaacaggcuuccuuucaacacgauaaagagaugcuccaagcacaaauugaggccacuaaaaaguugcaacaggagaugaugaaagucaaacaggcaaugcuccuagaagguggauucucugaaacagaugcagcccguggggcaaucaacgcccccaugacaaagguuuuggacuggagcggaacaagguacugggccccugacgcuaggaccacaacauacaaugcaggccgcuuuuccaccccucaaccuucggggacgcugccaggaagaaucaaucccagaacuccuacccccgcucggggcuccuccagcacaucuucuaaugcuucuacugcuacuucuauauauucaaaucaaacuguuucaacgagacuugguucuacagcugguucugguaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8636 - RNA, 807 nt, Artificial Sequence
  capsid_protein_VP2__Norovirus__AFX81221
auggcuggagcuuucuuugcuggauuggcaucugauguccuuggcucuggacuugguucccuaaucaacgcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcucccccagcacaucuucuaaugcuuccacugcuacuucuauauauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8637 - RNA, 807 nt, Artificial Sequence
  capsid_protein_VP2__Norovirus__AFX81224
auggcuggagcuuucuuugcuggauuggcaucugauguccuuggcucugggcuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggagaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuucuacugcuacuucuauauauucaaaccaaacuguuucaacgagacuugguucuacagcugguucuggcaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8638 - RNA, 807 nt, Artificial Sequence
  capsid_protein_VP2__Norovirus__AFX81227
auggcuggagcuuucuuugcuggauuggcaucugauguccuuggcucuggacuugguucccuaaucaacgcuggggcuggggccaucaaccaaaagauugauuuugaaaauaauagaaaauugcagcaagcuuccuuucaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccaguacaucuucuaaugcuuccacugcuacuucuauauauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8639 - RNA, 807 nt, Artificial Sequence
  capsid_protein_VP2__Norovirus__AFX81230
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcagugaucuacaacaggcuuccuuucaacacgauaaagagaugcuccaagcacaaauugaggccacuaaaaaguugcaacaggagaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccugcccccgcucgggguuccuccagcacaucuucuaaugcuucuacugcuacuucuauauauucaaaucaaacuguuucaacgagacuugguucuacagcugguucugguaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8640 - RNA, 807 nt, Artificial Sequence
  capsid_protein_VP2__Norovirus__AFX81233
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugagagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccaguacaucuucuaauguuucuacugccacuucuauauauucaaaucaaacuuuuucaacgagacuugguucuacagcugguucugguaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8641 - RNA, 807 nt, Artificial Sequence
  capsid_protein_VP2__Norovirus__AFX81239
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacgagguacugggccccugaugcuaggaccacaacauacaaugcaggccgcuuuuccaccccucaaccuucggggacgcugccaggaagaaucaaucccaggacucccacccccgcucggggcuccuccagcacaucuucuaauguuucuacugcuacuucuauauauucaaaucagacugcuucaacgagacuugguucuacagcugguucugguaccaaugucucgagucucccgucaacugcaagaacuaggaguuggguugaggaucaaaacagaaauuugucaccuuucaugaggggggcucauaacauaucguuugucaccccaccgucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8642 - RNA, 807 nt, Artificial Sequence
  capsid_protein_VP2__Norovirus__AFX81242
auggcuggagcuuucuuugcuggauuggcaucugacguccuuggcucuggacuugguucccuaaucaaugcuggggcuggggccaucaaucaaaaaguugaauuugaaaauaacagaaaauugcaacaagcuuccuuccaauuuaguaguaaucuacaacaggcuuccuuucaacaugacaaagagaugcuccaagcacaaauugaggccaccaaaaaguugcaacaggaaaugaugagaguuaaacaagcaaugcuccuagaggguggauucucugagacagaugcagcccguggggcaaucaacgcccccaugacaaaaacuuuggacuggaccgggacaagguacugggcucccgaugcuaggacuacaacauauaaugcaggccgcuuuuccaccccccaacccucgggggcacuaccaggaagagcuaaucuuagggcuacuguccccgcccgggguuccuccagcacguucucuaacucuucuauugcuacuucuguguauucaaaucaaaccaccucaacgagacuugguucuacagcugguucugguaccagugucucgagccucccgucaacugcaaggacuaggagcuggguugaggaucaaaauaggaauuugucaccuuucaugaggggggcccauaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8643 - RNA, 807 nt, Artificial Sequence
  capsid_protein_VP2__Norovirus__AFX81245
auggcuggagcuuucuuugcuggauuggcaucugacguccuuggcucuggacuugguucccuaaucaaugcuggggcuggggccaucaaccaaaaaguugaauuugaaaauaacagaaaauugcaacaagcuuccuuccaauuuaguagcagucuacaacaggcuuccuuucaacaugacaaagagaugcuccaagcacaaauugaggccaccaaaaaguugcaacaggaaaugaugagaguuaaacaagcaaugcuccuagaggguggauucucugagacagaugcagcccguggggcaaucaacgcccccaugacaaaaacuuuggacuggagcgggacaagguacugggcucccgaugcuaggacuacaacauauaaugcaggccgcuuuuccaccccccaacccucgggggcacuaccaggaagagcuaaucuuagggcuacuguccccgcccgggguuccuccagcacguccucuaacucuucuauugcuacuucuguguauucaaaucaaaccaccucaacgagacuugguucuacagcugguucugguaccagugucucgagccucccgucaacugcaaggacuaggagcuggguugaggaucaaaauaggaauuugucaccuuucaugaggggggcccauaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8644 - RNA, 807 nt, Artificial Sequence
  capsid_protein_VP2__Norovirus__AFX81248
auggcuggagcuuucuuugcuggauuggcaucugacguccuuggcucuggacuugguucccuaaucaaugcuggggcuggggccaucaaucaaaaaguugaauuugaaaauaacagaaaauugcagcaagcuuccuuccaauuuaguagcaaucuacaacaggcuuccuuucaacaugacaaagagaugcuccaagcacaaauugaggccaccagaaaguugcaacaggaaaugaugagaguuaaacaagcaaugcuccuagaggguggauucucugagacagaugcagcccguggggcaaucaacgcccccaugacaaaaacuuuggacuggagcgggacaagguacugggcucccgaugcuaggacuacaacauauaaugcaggccgcuuuuccaccccccaacccucgggggcacuaccaggaagagcuaaucuuagggcuacuguccccgcccgggguuccuccagcacguucucuaacucuucuauugcuacuucuguguauucaaaucaaaccaccucaacgagacuugguucuacagcugguucugguaccagugucucgagccucccgucaacugcaaggacuaggagcuggguugaggaucaaaauaggaauuugucaccuuucaugaggggggcccacaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8645 - RNA, 807 nt, Artificial Sequence
  capsid_protein_VP2__Norovirus__AFX81251
auggcuggagcuuucuuugcuggauuggcaucugacguccuuggcucuggacuugguucccuaaucaaugcuggggcuggggccaucaaucaaaaaguugaauuugaaaauaacagaaaauugcagcaagcuuccuuccaauuuaguagcaaucuacaacaggcuuccuuucaacacgacaaagagaugcuccaagcacaaauugaggccaccaaaaaguugcaacaggaaaugaugagaguuaaacaagcaaugcuccuagaggguggauucucugagacagaugcagcccgcggggcaaucaacgcccccaugacaaaaacuuuggacuggagcgggacaagguacugggcucccgaugcuaggacuacaacauauaaugcaggccgcuuuuccaccccccaacccucgggggcacuaccaggaagagcuaaucuuagggcuacuguccccgcccgggguuccuccagcacguucucuaacucuucuauugccacuucuguguauucaaaucaaaccaccucgacgagacuugguucuacagcugguucuggugccagugucucgagccucccgucaacugcaaggacuaggagcuggguugaggaucaaaauaggaauuugucaccuuucaugaggggggcccauaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8646 - RNA, 807 nt, Artificial Sequence
  capsid_protein_VP2__Norovirus__AFX81254
auggcuggagcuuucuuugcuggauuggcaucugacguccuuggcucuggacuugguucccuaaucaaugcuggggcuggggccaucaaucaaacaguugaauuugaaaauaacagaaaauugcaacaagcuuccuuccaauuuaguaguaaucuacaacaggcuuccuuucaacaugacaaagagaugcuccaagcacaaauugaggccaccaaaaaguugcaacaggaaaugaugagaguuaaacaagcaaugcuccuagaggguggauucucugagacagaugcagcccguggggcaaucaacgcccccaugacaaaaacuuuggacuggaccgggacaagauacugggcucccgaugcuaggacuacaacauauaaugcaggccgcuuuuccaccccccaacccucgggggcacuaccaggaagagcuaaucuuagggcuacuguccccgcccgggguuccuccagcacguucucuaacucuucuauugccacuucuguguauucaaaucaaaccaccucaacgagacuugguucuacagcugguucugguaccagugucucgagccucccgucaacugcaaggacuaggagcuggguugaggaucaaaauaggaauuugucaccuuucaugaggggggcccauaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8647 - RNA, 807 nt, Artificial Sequence
  capsid_protein_VP2__Norovirus__AFX81257
auggcuggagcuuucuuugcuggauuggcaucugacguccuuggcucuggacuugguucccuaaucaaugcuggggcuggggccaucaaccaaaaaguugaauuugaaaauaacagaaaauugcaacaagcuuccuuccaauuuaguagcagucuacaacaggcuuccuuucaacaugacaaagagaugcuccaagcacaaauugaggccaccaaaaaguugcaacaggaaaugaugagaguuaaacaagcaaugcuccuagaggguggauucucugagacagaugcagcccguggggcaaucaacgcccccaugacaaaaacuuuggacuggagcgggacaagguacugggcucccgaugcuaggacuacaacauauaaugcaggccgcuuuuccaccccccaacccucgggggcacuaccaggaagagcuaaucuuagggcuacuguccccgcccgggguuccuccagcacguccucuaacucuucuauugcuacuucuguguauucaaaucaaaccaccucaacgagacuugguucuacagcugguucugguaccagugucucgagccacccgucaacugcaaggacuaggagcuggguugaggaucaaaauaggaauuugucaccuuucaugaggggggcccauaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8648 - RNA, 807 nt, Artificial Sequence
  capsid_protein_VP2__Norovirus__AFX81260
auggcuggagcuuucuuugcuggauuggcaucugauguccuuggcucuggacuuggcucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauauaaugcaggccgcuuuuccaccccccaaccuucggggacgcugccaggaagaaucaaucccaggacuccuacccccgcucggggcuccuccagcacaucuucuaaugcuucuacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccccucuucgcucacacucguaggcgaggggagucacggguguaa

SEQ ID NO: 8649 - RNA, 807 nt, Artificial Sequence
  capsid_protein_VP2__Norovirus__AFX81263
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuucuacugcuacuucuauauauucaaaucaaacuguuucaacgagacuugguucuacagcugguucugguaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8650 - RNA, 807 nt, Artificial Sequence; identical to SEQ ID NO: 8649
  capsid_protein_VP2__Norovirus__AFX81269

SEQ ID NO: 8651 - RNA, 807 nt, Artificial Sequence; identical to SEQ ID NO: 8616
  capsid_protein_VP2__Norovirus__AFX81272

SEQ ID NO: 8652 - RNA, 807 nt, Artificial Sequence; identical to SEQ ID NO: 8649
  capsid_protein_VP2__Norovirus__AFX81275

SEQ ID NO: 8653 - RNA, 807 nt, Artificial Sequence; identical to SEQ ID NO: 8649
  capsid_protein_VP2__Norovirus__AFX81278

SEQ ID NO: 8654 - RNA, 807 nt, Artificial Sequence
  capsid_protein_VP2__Norovirus__AFX81281
auggcuggagcuuucuuugcuggauuggcaucugauguccuuggcucuggacuuggcucccugaucaacgcuggggcuggggcuaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggacuacaacauacaaugcaggccgcuuuuccaccccucaaccuucgggggcguugccaggaagaaucaaucccaggacuccuacccccgcucggggcuccuccagcacaucuucuaaugcuucuacugcuacuucuauacauucaaaucaaaccguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8655 - RNA, 807 nt, Artificial Sequence; identical to SEQ ID NO: 8649
  capsid_protein_VP2__Norovirus__AFX81284

SEQ ID NO: 8656 - RNA, 807 nt, Artificial Sequence
  capsid_protein_VP2__Norovirus__AFX81287
auggcuggagcuuucuuugcuggauuggcaucugauguccuuggcucuggacuuaguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccccaaccuucggggacgcugccaggaagaaucaaucccaggacuccuaccccugcucggggcuccuccagcacaucuucuaaugcuccuacugcuacuucuauacauucaaaucaaacuguuucaacgagacuugguucuacagcugguucuggcaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccccucuucgcucacauucguaggcgaggggagucacggguguaa

SEQ ID NO: 8657 - RNA, 807 nt, Artificial Sequence; identical to SEQ ID NO: 8649
  capsid_protein_VP2__Norovirus__AFX81290

SEQ ID NO: 8658 - RNA, 807 nt, Artificial Sequence; identical to SEQ ID NO: 8616
  capsid_protein_VP2__Norovirus__AFX81293

SEQ ID NO: 8659 - RNA, 807 nt, Artificial Sequence
  capsid_protein_VP2__Norovirus__AFX81296
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagagucaaucccaggacuccuacccccgcucggggcuccuccagcacaucuucuaaugcuucuacugcuacuucuauacauucaaaucaaacuguuucaacgagacuugguucuacagcugguucuggcaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8660 - RNA, 807 nt, Artificial Sequence
  capsid_protein_VP2__Norovirus__AFX81299
auggcuggagcuuucuuugcuggacuggcaucugauguccuuggcucuggacuugguucccuaaucaaugcuggggcuggggcuaucaaccaaaagauugauuuugaaaauaauagaaaauugcagcaagcuuccuuccaguuuagcaguaaucuucaacaggcuuccuuucaacacgauaaagagaugcuccaagcacaaaucgaggccacuaaaaaguugcaacaggaaaugaugaaagucaaacaggcaaugcuccuagaagguggauucucugaaacagaugcagcccguggggcaaucaacgcccccaugacaaaaguuuuggacuggagcggaacaagguacuggaccccugaugcuaggacuacaacauacaaugcaggccgcuuuuccaccccucaaccuucggggacgcugccaggaagaaucaaucccaggacuccuacccccgcucggggcuccuccaguacaucuucuaaugcuucuacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8661 - RNA, 807 nt, Artificial Sequence
  capsid_protein_VP2__Norovirus__AFX81302
auggcuggagcuuucuuugcuggauuggcaucugauguccuuagcucuggacuugguucccuaaucaaugcuggggcuggggcuaucaaccaaaagauugauuuugaaaauaacagaaaacugcagcaagcuuccuuccaauuuaguaguaaucuacaacaggcuuccuuucaacaugauaaggagaugcuccaagcacaaauugaggccacuaaaaaguuacaacaggaaaugaugaaagucaaacaggcaaugcucuuagaagguggauucucugaaacagaugcagcccguggggcaaucaaugccccuaugacaaaggcuuuggacuggagcggaacaagguacugggccccugaugcuaggacuacaacauauagugcaggccguuuuucuaccccucaaccuucgggggcacugccaggaagaaccaaucccagggccccuauccccgcccggggcucccccagcacaucuucuggugcuucuacugcuacuucuauauauucaaaucaaacuguuucaacgagacuugguucuacagcugguucuggcaccaaugucucgagucucccgucaacugcaaggacuaggaguuggguugaggaucaaaacaggaaucugucaccuuuuaugaggggggcucacaacauaucguuugucaccccaccaucuagcagguccucuagccaaggcacagucucaaccgugccuaaagaaguuuuggacuccuggacuggcgcuuucaauacgcgcaggcagccucucuucgcucacauucguaggcgaggggagucacggguguaa

SEQ ID NO: 8662 - RNA, 807 nt, Artificial Sequence
  capsid_protein_VP2__Norovirus__AFX81305
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcagugaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacagugcaggccgcuuuuccaccccucaaccuucggggacgcugccaggaagaaccaaucccaggacucccacccccgcucggggcuccuccagcacaucuucuaaugcuucuacugcuacuucuauacauucaaaucagacuguuucaacgagacuugguucuacagcugguucugguaccaaugucucgagucucccgucaacugcaaggacuaggaguuggguugaggaucaaaacagaaauuugucaccuuucaugaggggggcucauaauauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8663 - RNA, 807 nt, Artificial Sequence
  capsid_protein_VP2__Norovirus__AFX81308
auggcuggagcuuucuuugcuggauuggcaucugacguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuuccacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8664 - RNA, 807 nt, Artificial Sequence
  capsid_protein_VP2__Norovirus__AFX81311
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggagaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuucuacugcuacuucuauauauucaaaucaaacuguuucaacgagacuugguucuacagcugguucuggcaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8665 - RNA, 807 nt, Artificial Sequence
  capsid_protein_VP2__Norovirus__AFX81314
auggcuggagcuuucuuugcuggauuggcaucugauguccuuggcucuggacuugguucccuaaucaaugcuggggcuggggccaucaaccaaaagauugauuuugaaaauaacagaaaauugcagcaagcuuccuuccaguuuagcaguaaccuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacucccacccccgcucggggcuccuccagcacaucuucuaaugcuucuacugcuacuucuauacauucaaaucagacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauccguaggcgaggggagucacggguguaa

SEQ ID NO: 8666 - RNA, 807 nt, Artificial Sequence
  capsid_protein_VP2__Norovirus__AFX81317
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacucccacccccgcucggggcucauccagcacaucuucuaaugcuucuacugcuacuucuauacauucaaaucagacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8667 - RNA, 807 nt, Artificial Sequence; identical to SEQ ID NO: 8666
  capsid_protein_VP2__Norovirus__AFX81320

SEQ ID NO: 8668 - RNA, 807 nt, Artificial Sequence
  capsid_protein_VP2__Norovirus__AFX81323
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacagugcaggccgcuuuuccaccccucaaccuucggggacgcugccaggaagaaucaaucccaggacucccacccccgcucggggcuccuccagcacaucuucuaaugcuucuacugcuacuucuauacauucaaaucagacuguuucaacgagacuugguucuacagcugguucugguaccaaugucucgagucucccgucaacugcaaggacuaggaguuggguugaggaucaaaacagaaauuugucaccuuucaugaggggggcucauaauauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8669 - RNA, 807 nt, Artificial Sequence
  capsid_protein_VP2__Norovirus__AFX81326
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggccuccuuucaacacgauaaagagaugcuccaagcacaaauugaggccacuaaaaaguugcaacaggagaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuucuacugcuacuuccauauauucaaaucaaacuguuucaacgagacuugguucuacagcugguucuggcaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8670 - RNA, 807 nt, Artificial Sequence
  capsid_protein_VP2__Norovirus__AGE89434
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccacuccccaaccuucggggacgcugccaggaagaaucaaucccaggacuccuacccccgcucggggcuccuccagcacaucuucuaaugcuucuacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccccucuucgcucacauucguaggcgaggggagucacggguguaa

SEQ ID NO: 8671 - RNA, 807 nt, Artificial Sequence
  capsid_protein_VP2__Norovirus__AGE89437
auggcuggagcuuucuuugcuggacuggcaucugauguccuuggcucuggacuugguucccuaaucaaugcuggggcuggggcuaucaaccaaaagauugauuuugaaaauaauagaaaauugcagcaagcuuccuuccaguuuagcaguaaucuucaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuucuacugcuacuucuauacauucaaaucaaacuguuucaacgagacuugguucuacagcugguucugguaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8672 - RNA, 807 nt, Artificial Sequence
  capsid_protein_VP2__Norovirus__AGE89440
auggcuggagcuuucuuugcuggauuggcaucugacguccuuggcucuggacuugguucccuaaucagugcuggggcuggggccaucaaucaaaaaguugaauuugaaaauaacagaaaauugcaacaagcuuccuuccaauuuaguagcaaucuacaacaggcuuccuuucaacaugacaaagagaugcuccaagcacaaauugaggccaccaaaaaguugcaacaggaaaugaugagagucaaacaagcaaugcuccuagaggguggauucucugagacagaugcagcccguggggcaaucaacgcccccaugacaaaaacuuuggacuggagcgggacaagguacugggcucccgaugcuaggacuacaacauauaaugcaggccgcuuuuccaccccccaacccucgggggcacuaccaggaagagcuaaucuuagggcuacuguccccgcccgggguuccuccagcacguucucuaacucuucuauugcuacuucuguguauucaaaucaaaccaccucaacgagacuugguucuacagcugguucugguaccagugucucgagccucccgucaacugcaaggacuaggagcuggguugaggaucaaaauaggaauuugucaccuuucaugaggggggcccauaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8673 - RNA, 807 nt, Artificial Sequence
  capsid_protein_VP2__Norovirus__AGE89443
auggcuggagcuuucuuugcuggauuggcaucugacguccuuggcucuggacuugguucccuaaucaaugcuggggcuggggccaucaaccaaaaaguugaauuugaaaauaacagaaaauugcaacaagcuuccuuccaauuuaguagcaaucuacaacaggcuuccuuucaacaugacaaagagaugcuccaagcacaaauugaggccaccaaaaaguugcaacaggaaaugaugagaguuaaacaagcaaugcuccuagaggguggauucucugagacagaugcagcccguggggcaaucaacgcccccaugacaaaaacuuuggacuggagcgggacaagguacugggcucccgaugcuaggacuacaacauauaaugcaggccgcuuuuccaccccccaacccucgggggcacuaccaggaagagcuaaucuuagggcuacuguccccgcccgggguuccuccagcacguccucuaacgcuucuauugcuacuucuguguauucaaaucaaaccaccucaacgagacuugguucuacagcugguucugguaccagugucucgagucucccgucaacugcaaggacuaggagcuggguugaggaucaaaauaggaauuugucaccuuucaugaggggggcccauaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8674 - RNA, 807 nt, Artificial Sequence
  capsid_protein_VP2__Norovirus__AGE89449
auggcuggagcuuucuuugcuggauuggcaucugacguccuuggcucuggacuugguucccuaaucaaugcuggggcuggggccaucaaucaaaaaguugaauuugaaaauaacagaaaauugcaacaagcuuccuuccaauuuaguagcaaucuacaacaggcuuccuuucaacaugacaaagagaugcuccaagcacaaauugaggccaccaaaaaguugcaacaggaaaugaugagaguuaaacaagcaaugcuucuagaggguggauucucugagacagaugcagcccguggggcaaucaacgcccccaugacaaaaacuuuggacuggagcgggacaagguacugggcucccgaugcuaggacuacaacauauaaugcaggccgcuuuuccaccccccaacccucggggguacuaccaggaagagcuaaucuuagggcuacuguccccgcccgggguuccuccagcacguucucuaacucuucuauugcuacuucuguguauucaaaucaaaccaccucaacgagacuugguucuacagcugguucugguaccagugucucgagccucccgucaacugcaaggacuaggagcuggguugaggaucaaaauaggaauuugucaccuuucaugaggggggcccauaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8675 - RNA, 807 nt, Artificial Sequence; identical to SEQ ID NO: 8654
  capsid_protein_VP2__Norovirus__AGE89455

SEQ ID NO: 8676 - RNA, 807 nt, Artificial Sequence; identical to SEQ ID NO: 8616
  capsid_protein_VP2__Norovirus__AGE89458

SEQ ID NO: 8677 - RNA, 807 nt, Artificial Sequence
  capsid_protein_VP2__Norovirus__AGE89461
auggcuggagcuuucuuugcuggacuggcaucugauguccuuggcucuggacuugguucccuaaucaaugcuggggcuggggcuaucaaucaaaagauugauuuugaaaauaauagaaaauugcagcaagcuuccuuccaguuuagcaguaaucuucaacaggcuuccuuucaacacgauaaagagaugcuccaagcacaaaucgaggccacuaaaaaguugcaacaggaaaugaugaaagucaaacaggcaaugcuccuagaagguggauucucugaaacagaugcagcccguggggcaaucaacgcccccaugacaaaaguuuuggacuggagcggaacaagguacugggccccugaugcuaggacuacaacauacaaugcaggccgcuuuuccaccccucaaccuucggggacgcugccaggaagaaucaaucccaggacuccuacccccgcucggggcuccuccaguacaucuucuaaugcuucuacugcuacuucuauauauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8678 - RNA, 807 nt, Artificial Sequence
  capsid_protein_VP2__Norovirus__AGE89464
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacucccacccccgcucggggcuccuccagcacaccuucuaaugcuucuacugcuacuucuauacauucaaaucagacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8679 - RNA, 807 nt, Artificial Sequence; identical to SEQ ID NO: 8612
  capsid_protein_VP2__Norovirus__AGE89467

SEQ ID NO: 8680 - RNA, 807 nt, Artificial Sequence
  capsid_protein_VP2__Norovirus__AGE89470
auggcuggagcuuucuuugcuggauuggcaucugauguucuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuagggccacaacauacaaugcaggccgcuucuccaccccucaaccuucggggacgcuaccaggaagaaucaaucccaggacuccuacccccgcucggggcucccccagcacaucuucuaaugcuucuacugcuacuucuauauauucaaaucaaacuguuucaacgagacuugguucuacagcugguucugguaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8681 - RNA, 807 nt, Artificial Sequence
  capsid_protein_VP2__Norovirus__AGE89473
auggcuggagcuuucuuugcuggauuggcaucugauguccuuggcucuggacuuggcucccugaucaacgcuggggcuggggcuaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggacuacaacauacaaugcaggccgcuucuccaccccucaaccuucgggggcguugccaggaagaaucaaucccaggacuccuacccccgcucggggcuccuccagcacaucuucuaaugcuucuauugcuacuucuauacauucaaaucaaaccguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8682 - RNA, 807 nt, Artificial Sequence
  capsid_protein_VP2__Norovirus__AGE89476
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacucccacccccgcucggggcuccuccagcacaucuuuuaaugcuucuacugcuacuucuauacauucaaaucagacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8683 - RNA, 807 nt, Artificial Sequence
  capsid_protein_VP2__Norovirus__AGE89479
auggcuggagcuuucuuugcuggauuggcaucugauguccuuggcucuggacuugguucccuaaucaaugcuggggcuggggccaucaaccaaaagauugauuuugaaaauaacagaaaauugcagcaagcuuccuuccaguuuagcaguaaccuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaucuucggggacgcugccaggaagaaucaaucccaggacucccacccccgcucggggcuccuccagcacaucuucuaaugcuucuacugcuacuucuauacauucaaaucagacuguuucaacgagacuugguucuacagcugguucugguaccaaugucucgagucacccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauccguaggcgaggggagucacggguguaa

SEQ ID NO: 8684 - RNA, 807 nt, Artificial Sequence; identical to SEQ ID NO: 8664
  capsid_protein_VP2__Norovirus__AGE89482

SEQ ID NO: 8685 - RNA, 807 nt, Artificial Sequence
  capsid_protein_VP2__Norovirus__AGE89485
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccccaaccuucggggacgcugccaggaagaaucaaucccaggacuccuacccccgcucggggcuccuccagcacaucuucuaaugcuucuacugcuacuucuauacauucaaaucaaacuguuucaacgagacuugguucuacagcugguucuggcaccaaugucucgagucucccgucaacugcaaggacuaggaguuggguugaggaucaaaacagaaauuugucaccuuucaugaggggggcucguaacauaucguuugucaccccaccaucuagcagauccucuagccaaggcacagucucaaccgugccuaaagaaguuuuggacuccuggacuggcgcuuucaacacgcgcaggcagccccucuucgcucacauucguaggcgaggggagucacggguguaa

SEQ ID NO: 8686 - RNA, 807 nt, Artificial Sequence
  capsid_protein_VP2__Norovirus__AGE89488
auggcuggggcuuucuuugcuggauuggcaucugauguccuuggcucuggacuuggcucccuaaucaaugcuggggcuggggcuaucaaccaaaagauugauuuugaaaauaacagaaaauugcagcaagcuuccuuccaguuuagcaguaaucuacaacaggccuccuuucaacaugacaaagagaugcuccaagcacaaauugaggccacuaaaaaguugcaacaggaaaugaugaaagucaaacaggcaaugcucuuagaagguggguucucugaaacagaugcagcucguggggcaaucaacgcccccaugacaaagguuuuggacuggagcggaacaagguacugggccccugaugcuaggacuacaacauacaaugcaggccgcuuuuccgccccucaacccucggggucauugccaggaagaaucaaucccagggcuccuacccccgcucgggucuccuccaguacauccucuaaugcuucuacuguuacuucuauauauucaaaucaaacuguuucaacgagacuugguucuacagcuggcucuggcaccaaugucucgagucucccgucaacugcaaggacuaggaguuggguugaggaucaaaacagaaauuugucaccuuucaugaggggggcucacaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8687 - RNA, 807 nt, Artificial Sequence; identical to SEQ ID NO: 8612
  capsid_protein_VP2__Norovirus__AGE89491

SEQ ID NO: 8688 - RNA, 807 nt, Artificial Sequence
  capsid_protein_VP2__Norovirus__AGE89494
auggcuggagcuuucuuugcuggauuggcaucugauguccuuggcucuggacuugguucccuaaucaacgcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccauaacauacaaugcaggccgcuuuuccaccccucaaccuucggggacgcugccaggaagaaucaaucccagggcuccuacccccgcucggggcuccuccagcacaucuucuaaugcuuccacugcuacuucuauauauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8689 - RNA, 807 nt, Artificial Sequence
  capsid_protein_VP2__Norovirus__AGE89497
auggcuggagcuuucuuugcuggauuggcaucugauguccuuggcucuggacuugguucccuaaucagugcuggggcuggggccaucaaccaaaagauugauuuugaaaauaauagaaaauugcaacaagcuuccuuccaguuuagcaguaaucuacaacaggccuccuuucaacacgauaaagagaugcuccaagcacaaauugaggccacuaaaaaguugcaacaggagaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuucuacugcuacuucuauauauucaaaucaaacuguuucaacgagacuugguucuacagcugguucuggcaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8690 - RNA, 807 nt, Artificial Sequence
  capsid_protein_VP2__Norovirus__AGE89500
auggcuggagcuuucuuugcuggauuggcaucugauguccuuggcucuggacuugguucccuaaucaaugcuggggcuggggccaucaaccaaaagauugauuuugaaaauaacagaaaauugcagcaagcuuccuuccaguuuagcaguaaccuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacucccacccccgcucggggcuccuccagcacaucuucuaaugcuucuacugcuacuucuauacauucaaaucagacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8691 - RNA, 807 nt, Artificial Sequence; identical to SEQ ID NO: 8625
  capsid_protein_VP2__Norovirus__AGE89503

SEQ ID NO: 8692 - RNA, 807 nt, Artificial Sequence
  capsid_protein_VP2__Norovirus__AGE89506
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacucccacccccgcucggggcuccuccagcacaucuucuaaugcuucuacugcuacuucuaugcauucaaaucagacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8693 - RNA, 807 nt, Artificial Sequence
  capsid_protein_VP2__Norovirus__AGE89509
auggcuggggcuuucuuugcuggauuggcaucugauguccuuggcucuggacuuggcucccuaaucaaugcuggggcuggggcuauuaaccaaaagauugauuuugaaaauaacagaaaauugcagcaagcuuccuuccaguuuagcaguaaucuacaacaggccuccuuucaacaugacaaagagaugcuccaagcacaaauugaggccacuaaaaaguugcaacaggaaaugaugaaagucaaacaggcaaugcucuuagaagguggguucucugaaacagaugcagcucguggggcaaucaacgcccccaugacaaagguuuuggacuggagcggaacaagguacugggccccugaugcuaggacuacaacauacaaugcaggccgcuuuuccaccccucaacccucggggucauugccaggaagaaucaaucccagggcuccuacccccgcucgggccuccuccaguauauccucuaaugcuucuacuguuacuucuauauauucaaaucaaacuguuucaacgagacuugguucuacagcuggcucuggcaccaaugucucgagucucccgucaacugcaaggacuaggaguuggguugaggaucaaaacagaaauuugucaccuuucaugaggggggcucacaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8694 - RNA, 807 nt, Artificial Sequence; identical to SEQ ID NO: 8621
  capsid_protein_VP2__Norovirus__AGE89512

SEQ ID NO: 8695 - RNA, 807 nt, Artificial Sequence; identical to SEQ ID NO: 8620
  capsid_protein_VP2__Norovirus__AGE89515

SEQ ID NO: 8696 - RNA, 807 nt, Artificial Sequence
  capsid_protein_VP2__Norovirus__AGE89518
auggcuggagcuuucuuugcuggauuggcaucugauguccuuggcucuggacuugguucccuaaucaaugcuggggcuggggccaucaaccaaaagauugauuuugaaaauaacagaaaauugcagcaagcuuccuuccaguuuagcaguaaccuacaacaggcuuccuuucaacacgauaaagagaugcuccaagcacaaauugaggccacuaaaaaguugcaacaggaaaugaugaaagucaaacagacaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccagaacucccacccccgcucggggcuccuccagcacaucuucuaaugcuucuacugcuacuucuauacauucaaaucagacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8697 - RNA, 807 nt, Artificial Sequence
  capsid_protein_VP2__Norovirus__AGE89521
auggcuggagcuuucuuugcuggauuggcaucugauguccuuggcucuggacuugguucccuaaucaaugcuggggcuggggccaucaaccaaaagauugauuuugaaaauaauagaaaauugcagcaaguuuccuuccaguuuagcaguaaucuacaacaggcuuccuuucaacacgauaaagagaugcuccaagcacaaauugaggccacuaagaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuuccacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcccacauucguaggcgaggggagucacggguguaa

SEQ ID NO: 8698 - RNA, 807 nt, Artificial Sequence; identical to SEQ ID NO: 8612
  capsid_protein_VP2__Norovirus__AGE89524

SEQ ID NO: 8699 - RNA, 807 nt, Artificial Sequence
  capsid_protein_VP2__Norovirus__AGE89530
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggagaugaugaaagucaaacaggcaaugcuccuagaagguggauucucugaaacagaugcagcccguggggcaaucaacgcccccaugacaaagguuuuggauuggagcggaacaagguacugggccccugaugcuaggaccacaacauacaaugcaggccgcuuuuccaccccucaaccuucggggacgcugccaggaagaaccaaucccaggacuccuacccccgcucggggcuccuccagcacaucuucuaaugcuucuacugcuacuucuauauauucaaaucaaacuguuucaacgagacuugguucuacagcugguucuggcaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8700 - RNA, 807 nt, Artificial Sequence
  capsid_protein_VP2__Norovirus__AGE89533
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaauuaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacagugcaggccgcuuuuccaccccucaaccuucggggacgcugccaggaagaaucaaucccaggacucccacccccgcucggggcuccuccagcacauuuucuaaugcuucuacugcuacuucuauacauucaaaucagacuguuucaacgagacuugguucuacagcugguucugguaccaaugucucgagucucccgucaacugcaaggacuaggaguuggguugaggaucaaaacagaaauuugucaccuuucaugaggggggcucauaauauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8701 - RNA, 807 nt, Artificial Sequence
  capsid_protein_VP2__Norovirus__AGE89536
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggagaugaugaaagucaaacaggcaaugcuccuagaagguggauuuucugaaacagaugcagcccguggggcaaucaacgcccccaugacaaagguuuuggacuggagcggaacaagguacugggccccugacgcuaggaccacaacauacaaugcaggccgcuuuuccaccccucaaccuucggggacgcugccaggaagaaucaaucccaggaccccuacccccgcucggggcuccuccagcacaucuucuaaugcuucuacugcuacuucuauauauucaaaucaaacuguuucaacgagacuugguucuacagcugguucugguaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8702 - RNA, 807 nt, Artificial Sequence
  capsid_protein_VP2__Norovirus__AGE89539
auggcuggagcuuucuuugcuggauuggcaucugauguccuuggcucuggacuugguucucuaaucaaugcuggggcuggggccaucaaccaaaagauugauuuugaaaauaauagaaaauugcagcaagcuuccuuccaguuuagcaguaaucugcaacaggcuuccuuucaacacgauaaagagaugcuccaagcacaaauugaggccacuaaaaaguugcaacaggagaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacucccacccccgcucggggcuccuccagcacaucuucuaaugcuucuacugcuacuucuauauauucaaaucaaacuguuucaacgagacuugguucuacagcugguucuggcaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8703 - RNA, 807 nt, Artificial Sequence; identical to SEQ ID NO: 8664
  capsid_protein_VP2__Norovirus__AGE89542

SEQ ID NO: 8704 - RNA, 807 nt, Artificial Sequence
  capsid_protein_VP2__Norovirus__AGE89545
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggagaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuucuacugcuacuucuauauauucaaaucaaacuguuucaacgagacuugguucuacagcugguucugguaccaaugucucgagucucccgucaacugcaaggacuaggagcuggguugaggaucaaaacagaaauuugucaccuuucaugaggggggcucauaacauaucguuugucaccccaccgucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8705 - RNA, 807 nt, Artificial Sequence
  capsid_protein_VP2__Norovirus__AGE89548
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaucacaacauacaaugcaggccgcuuuuccaccccucaaccuucggggacgcugccaggaagaaucaaucccaggacucccacccccgcucggggcuccuccagcacaucuucuaaugcuucuacugcuacuucuauacauucaaaucagacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8706 - RNA, 807 nt, Artificial Sequence
  capsid_protein_VP2__Norovirus__AGE89551
auggcuggagcuuucuuugcuggauuggcaucugauguccuuggcucuggacuugguucccuaaucaaugcuggggcuggggccaucaaccaaaagauugauuuugaaaauaauaggaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuuccacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8707 - RNA, 807 nt, Artificial Sequence
  capsid_protein_VP2__Norovirus__AGE89554
auggcuggggcuuucuuugcuggauuggcaucugauguccuuggcucuggacuuggcucccuaaucaaugcuggggcuggggcuaucaaccaaaagauugauuuugaaaauaacagaaaauugcagcaagcuuccuuccaguuuagcaguaaucuacaacaggccuccuuucaacaugacaaagagaugcuccaagcacaaauugaggccacuaaaaaguugcaacaggaaaugaugaaagucaaacaggcaaugcucuuagaagguggguucucugaaacagaugcagcucguggggcaaucaacgcccccaugacaaagguuuuggacuggagcggaacaagguacugggccccugaugcuaggacuacaacauacaaugcaggccgcuuuuccgccccucaacccucggggucauugccaggaagaaucaaucccagggcuccuacccccgcucgggucuccuccaguacauccucuaaugcuucuacuguuacuucuauauauucaaaucaaacuguuucaacgagacuugguucuacagcuggcucuggcaccaaugucucgagucucccgucaacugcaaggacuaggaguuggguugaggaucaaaacagaaauuugucaccuuucaugaggggggcucacaacauaucguuugucaccccaccaucuagcagauccucuagccaaggcacagucucaaccgugccuaaagaaguuuuggacuccuggacuggcgcuuucaacacgcgcaggcagccucucuucgcucacguucguaggcgaggggagucacggguguaa

SEQ ID NO: 8708 - RNA, 807 nt, Artificial Sequence
  capsid_protein_VP2__Norovirus__AGE89557
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggagaugaugaaagucaaacaggcaaugcuccuagaagguggauucucugaaacagaugcagcccguggggcaaucaacgccccuaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcuucuacugcuacuucuauauauucaaaucaaacuguuucaacgagacuugguucuacagcugguucuggcaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8709 - RNA, 807 nt, Artificial Sequence
  capsid_protein_VP2__Norovirus__AGE89560
auggcuggagcuuucuuugcuggauuggcaucugauguccuuggcucugggcuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggagaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaauuccaggacuccuacccccgcucggggcuccuccagcacaucuucuaaugcuucuacugcuacuucuauauauucaaaucaaacuguuucaacgagacuugguucuacagcugguucuggcaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8710 - RNA, 807 nt, Artificial Sequence
  capsid_protein_VP2__Norovirus__AGE89563
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccccaaccuucggggaugcugccaggaaggaucaaucccaggacuccuacccccgcucggggcuccuccagcacgucuucuaaugcuucuacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8711 - RNA, 807 nt, Artificial Sequence
  capsid_protein_VP2__Norovirus__AGE89566
auggcuggagcuuucuuugcuggauuggcaucugauguccuuagcucuggacuugguuccuuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggagaugaugaaagucaaacaggcaaugcuccuagaagguggauucucugaaacagaugcagcccguggggcaaucaaugcccccaugacaaagguuuuggacuggagcggaacaagguacugggccccugaugcuaggaccacaacauacaaugcaggccgcuuuuccaccccucaaccuucggggacgcugccaggaagaaucaaucccaggauuccuacccccgcucggggcuccuccagcacaucuucuaaugcuucuacugcuacuucuauauauucaaaucaaacuguuucaacgagacuugguucuacagcugguucugguaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8712 - RNA, 807 nt, Artificial Sequence; identical to SEQ ID NO: 8630
  capsid_protein_VP2__Norovirus__AGE89569

SEQ ID NO: 8713 - RNA, 807 nt, Artificial Sequence; identical to SEQ ID NO: 8632
  capsid_protein_VP2__Norovirus__AGE89572

SEQ ID NO: 8714 - RNA, 807 nt, Artificial Sequence
  capsid_protein_VP2__Norovirus__AGE89578
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugcuagaaagagucaaucccaggacuccuacccccgcucggggcuccuccagcacaucuucuaaugcuucuacugcuacuucuauacauucaaaucaaacuguuucaacgagacuugguucuacagcugguucuggcaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcagacagccucucuucgcucacauucguaggcgaggggagucacggguguaa

SEQ ID NO: 8715 - RNA, 807 nt, Artificial Sequence
  capsid_protein_VP2__Norovirus__AGE89581
auggcuggagcuuucuuugcuggauuggcaucugauguccuuggcucuggacuugguucccuaaucaacgcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaagugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaaggaucaaucccaggacuccuacccccgcucggggcuccuccagcacaucuucuaaugcuuccacugcuacuucuauauauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8716 - RNA, 807 nt, Artificial Sequence
  capsid_protein_VP2__Norovirus__AGE89587
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccccaaccuucggggaugcugccaggaagaaucaaucccaggacuccuacccccgcucggggcuccuccagcacaucuucuaaugcuucuacugcuacuucuauacauucaaaucaaacuguuucaacgagacuugguucuacagcugguucugguaccaaugucucgagucucccgucaacugcaaggacuaggaguuggguugaggaucaaaauagaaauuugucacccuucaugaggggggcucauaauauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8717 - RNA, 807 nt, Artificial Sequence
  capsid_protein_VP2__Norovirus__AGE89590
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccagaaagagucaaucccaggacuccuacccccgcucggggcuccuccagcacaucuucuaaugccucuacugcuacuucuauacauucaaaucaaacuguuucaacgagacuugguucuacagcugguucuggcaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8718 - RNA, 807 nt, Artificial Sequence; identical to SEQ ID NO: 8626
  capsid_protein_VP2__Norovirus__AGE89593

SEQ ID NO: 8719 - RNA, 807 nt, Artificial Sequence
  capsid_protein_VP2__Norovirus__AGE89596
auggcuggagcuuucuuugcuggauuggcaucugacguccuuggcucuggacuugguucccuaaucaaugcuggggcuggggccaucaaccaaaaaguugaauuugaaaauaacagaaaauugcaacaagcuuccuuccaauuuaguagcaaucuacaacaggcuuccuuucaacaugacaaagaaaugcuccaagcacaaauugaggccaccaaaaaguugcaacaggaaaugaugagaguuaaacaggcaaugcuccuagaggguggauucucugagacagaugcagcccguggggcaaucaacgcccccaugacaaaaacuuuggacuggagcgggacaagguacugggcucccgaugcuaggacuacaacauauaaugcaggccgcuuuuccaccccccaacccucgggggcacuaccaggaagagcuaaucuuagggcuacuguccccgcccgggguuccuccagcacguccucuaacucuucuauugcuacuucuguguauucaaaucaaaccaccucaacgagacuugguucuacagcugguucugguaccagugucucgagccucccgucaacugcaaggacuaggagcuggguugaggaucaaaauaggaauuugucaccuuucaugaggggggcccauaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8720 - RNA, 807 nt, Artificial Sequence
  capsid_protein_VP2__Norovirus__AGE89599
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaccaaucccaggacuccuacccccgcucggggcuccuccagcauaucuucuaaugcuuccacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8721 - RNA, 807 nt, Artificial Sequence
  capsid_protein_VP2__Norovirus__AGE89602
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacucccacccccgcucggggcuccuccagcacaucuucuaaugcuucuacugcuacuucuauacauucaaaucagacugcuucaacgagacuugguucuacagcugguucugguaccaaugucucgagccucccgucaacugcaagaacuaggaguuggguugaggaucaaaacagaaauuugucaccuuucaugaggggggcucauaacauaucguuugucaccccaccgucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8722 - RNA, 807 nt, Artificial Sequence
  capsid_protein_VP2__Norovirus__AGE89605
auggcuggggcuuucuuugcuggauuggcaucugauguccuuggcucuggacuugguucccuaaucaaugcuggggcuggggcuaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccccaaccuucggggacgcugccaggaagaaucaaucccaggacuccuacccccgcucggggcuccuccagcacaucuucuaaugcuucuacugcuacuucuauacauucaaaucaaacuguuucaacgagacuugguucuacagcugguucugguaccaaugucucgagucucccgucaacugcaaggacuaggaguuggguugaggaucaaaacagaaguuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccccucuucgcucacauucguaggcgaggggagucacggguguaa

SEQ ID NO: 8723 - RNA, 807 nt, Artificial Sequence
  capsid_protein_VP2__Norovirus__AGE89608
auggcuggggcuuucuuugcuggauuggcaucugauguccuuggcucuggacuugguucccuaaucaaugcuggggcuggggcuaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccccaaccuucggggacgcugccaggaagaaucaaucccaggacuccuacccccgcucggggcuccuccagcacaucuucuaaugcuucuacugcuacuucuauacauucaaaucaaacuguuucaacgagacuugguuauacagcugguucugguaccaaugucucgagucucccgucaacugcaaggacuaggaguuggguugaggaucaaaacagaaguuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccccucuucgcucacauucguaggcgaggggagucacggguguaa

SEQ ID NO: 8724 - RNA, 807 nt, Artificial Sequence
  capsid_protein_VP2__Norovirus__AGE89611
auggcuggagcuuucuuugcuggauuggcaucugauguccuuggcucuggacuugguucccuaaucaacgcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucagcgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaaugcucccacugcuacuucuauauauucaaaucaaacuguuucaacgagacuugguucuacagcugguucugguaccaaugucucgagucucccgucaacugcaaggacuaggaguuggguugaggaucaaaacagaaauuugucaccuuucaugaggggggcccauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8725 - RNA, 807 nt, Artificial Sequence
  capsid_protein_VP2__Norovirus__AGE89614
auggcuggggcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccccaaccuucggagacgcugccaggaagaaucaaucccaggacuccuacccccgcucggggcuccuccagcacaucuucuaaugcuucuacugcuacuucuauacauucaaaucaaacuguuucaacgagacuugguucuacagcugguucugguaccaaugucucgagucucccgucaacugcaaggacuaggaguuggguugaggaucaaaacagaaguuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccccucuucgcucacauucguaggcgaggggagucacggguguaa

SEQ ID NO: 8726 - RNA, 807 nt, Artificial Sequence
  capsid_protein_VP2__Norovirus__AGE89617
auggcuggagcuuucuuugcuggauuggcaucugacguccuuggcucuggacuugguucccuaaucaaugcuggggcuggggccaucaaccaaaaaguugaauuugaaaacaacagaaaauugcaacaagcuuccuuccaauuuaguagcaaucuacaacaggcuuccuuucaacaugacaaagagaugcuccaagcacaaauugaggccaccaaaaaguugcaacaggagaugaugagaguuaaacaagcaaugcuccuagaggguggauucucugagacagaugcagcccguggggcaaucaacgcccccaugacaaaaacuuuggacuggagcgggacaagguacugggcucccgaugcuaggacuacaacauauaaugcaggccgcuuuuccaccccccaacccucgggggcacuaccaggaagagcuaaucuuagggccacuguccccgcccgggguuccuccagcacguccucuaacucuucuauugcuacuucuguguauucaaaucaaaccaccucaacgagacuugguucuacagcugguucugguaccagugucucgagucucccgucaacugcaaggacuaggagcuggguugaggaucaaaauaggaauuugucaccuuucaugaggggggcccauaacaucucguucgucaccccaccaucuagcagauccuccagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8727 - RNA, 807 nt, Artificial Sequence; identical to SEQ ID NO: 8627
  capsid_protein_VP2__Norovirus__AGE89620

SEQ ID NO: 8728 - RNA, 807 nt, Artificial Sequence
  capsid_protein_VP2__Norovirus__AGE89623
auggcuggagcuuucuuugcuggauuggcaucugacguccuuggcucuggacuugguucccuaaucaaugcuggggcuggggccaucaaucaaaaaguugaauuugaaaauaauagaaaauugcaacaagcuuccuuccaauuuaguagcaaucuacaacaggcuuccuuucaacaugacaaagagaugcuccaagcacaaauugaggccaccaaaaaguugcaacaggaaaugaugagaguuaaacaagcaaugcuccuagaggguggauucucugagacagaugcagcccguggggcgaucaacgcccccaugacaaaaacuuuggacuggagcgggacaagguacugggcucccgaugcuaggacuacaacauauaaugcaggccgcuuuuccaccccccaacccucgggggcacuaccaggaagagcuaaucuuagggcuacuguccccgcccgggguuccuccagcacguucucuaacucuucuauugcuacuucuguguauucaaaucaaaccaccucaacgagacuugguucuacagcugguucuggcaccagugucucgagccucccgucaacugcaaggacuaggagcuggguugaggaucaaaauaggaauuugucaccuuucaugaggggggcccauaacaucucguaugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8729 - RNA, 807 nt, Artificial Sequence
  capsid_protein_VP2__Norovirus__AGE89626
auggcuggagcuuucuuugcuggauuggcaucugacguccuuggcucuggacuugguucccuaaucaaugcuggggcuggggccaucaaucaaaaaguugaauuugaaaauaacagaaaauugcaacaagcuuccuuccaauuuaguaguaaucuacaacaggcuuccuuucaacaugacaaagagaugcuccaagcacaaauugaggccaccaaaaaguugcaacaggaaaugaugagaguuaaacaagcaaugcuccuagaggguggauucucugagacagaugcagcccguggggcaaucaaugcccccaugacaaaaacuuuggacuggagcgggacaagguacugggcucccgaugcuaggacuacaacauauaaugcaggccgcuuuuccaccccccaacccucgggggcacuaccaggaagagcuaaucuuagggcuacuguccccgcccgggguuccuccagcacguucucuaacucuucuauugcuacuucuguguauucaaaucaaaccaccucaacgagacuugguucuacagcugguucugguaccagugucucgagccucccgucaacugcaaggacuaggagcuggguugaggaucaaaauaggaauuugucaccuuucaugaggggggcccauaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8730 - RNA, 807 nt, Artificial Sequence
  capsid_protein_VP2__Norovirus__AGE89629
auggcuggagcuuucuuugcuggauuggcaucugacguccuuggcucuggacuugguucccuaaucaaugcuggggcuggggccaucaaucaaaaaguugaauuugaaaauaacagaaaauugcaacaagcuuccuuccaauuuaguagcaaucuacaacaggcuuccuuucaacaugauaaagagaugcuccaagcacaaauugaggccaccaaaaaguugcaacaggaaaugaugagaguuaaacaagcaaugcuccuagaggguggauucucugagacagaugcagcccguggggcaaucaacgcccccaugacaaaaacuuuggacuggagcgggacaagguacugggcucccgaugcuaggacuacaacauauaaugcaggccgcuuuuccaccccccaacccucgggggcacuaccaggaggagcuaaucuuagggcuacuguccccgcccgggguuccuccagcacguucucuaacucuuccauugcuacuucuguguauucaaaucaaaccaccucaacgagacuugguucuacagcugguucugguaccagugucucgagccucccgucaacugcaaggacuaggagcuggguugaggaucaaaauaggaauuugucaccuuucaugaggggggcccauaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8731 - RNA, 807 nt, Artificial Sequence; identical to SEQ ID NO: 8612
  capsid_protein_VP2__Norovirus__AGE89635

SEQ ID NO: 8732 - RNA, 807 nt, Artificial Sequence
  capsid_protein_VP2__Norovirus__AGE89638
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucugcaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccccaaccuucggggacgcugccaggaagaaucaaucccaggacuccuacccccgcucggggcuccuccagcacaucuucuaaugcuucuacugcuacuucuauacauuuaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccccucuucgcucacauucguaggcgaggggagucacggguguaa

SEQ ID NO: 8733 - RNA, 807 nt, Artificial Sequence
  capsid_protein_VP2__Norovirus__AGE89641
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcacaucuucuaauguuucuacugcuacuucuauauauucaaaucaaacuguuucaacgagacuugguucuacagcugguucugguaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8734 - RNA, 807 nt, Artificial Sequence
  capsid_protein_VP2__Norovirus__AGE89644
auggcuggagcuuucuuugcuggauuggcaucugauguccuuggcucuggacuuggcucccugaucaacgcuggggcuggggcuaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggacuacaacauacaaugcaggccgcuuuuccaccccucaaccuucgggggcguugccaggaagaaucaaucccaggacuccuacccccgcucggggcuccuccagcacaucuucuaaugcuucuacugcuacuucuauacauucaaaucaaaccguuucaacuagacuugguucuacagcugguucugguaccaaugucucgggucucccgucaacugcaaggacuaggaguuggguugaggaucaaaacaggaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8735 - RNA, 807 nt, Artificial Sequence
  capsid_protein_VP2__Norovirus__AGE89647
auggcuggagcuuucuuugcuggguuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccagcauaucuucuaaugcuucuacugcuacuucuauacauucaaaucaaacuguuucaacgagacuugguucuacagcugguucugguaccaaugucucgaguuucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8736 - RNA, 807 nt, Artificial Sequence
  capsid_protein_VP2__Norovirus__AGE89650
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccccaaccuucggggaugcugccaggaagaaucaaucccaggacuccuacccccgcucggggcuccuccagcacaucuucuaaugcuucuacugcuacuucuauacauucaaaucaaacuguuucaacgagacuugguucuacagcugguucugguaccaaugucucgagucucccgucaacugcaaggacuaggaguuggguugaggaucaaaacagaaauuugucacccuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8737 - RNA, 807 nt, Artificial Sequence
  capsid_protein_VP2__Norovirus__AGE89653
auggcuggagcuuucuuugcuggauuggcaucugacguccugggcuccggacuugguucucugaucaaugccggggcuggggccaucaaccaaaaaguugaauuugaaaauaacagaaaauugcaacaagcuuccuuccaauuuagcagcaaucuacaacaggcuuccuuucagcaugauaaagagaugcuccaagcacaaauugaggccaccaaaaaguugcaacaggaaaugaugagaguuaaacaggcaaugcuccuagaggguggauucucugagacagaugcagcccguggggcaauuaacgcccccaugacaaaggcuuuggacuggagugggacaagguacugggcucccgaugcuaggacuacaacauacaaugcaggccacuuuuccaccccucaauccucgggggcacugccagggagagcuaaccuuagggcugcugucccugcucgaggcuccucuagcacaucuucuaacucuucuacugcuacuucuguguacucaaaucaaacuauuucaacgagacuugguucuacagcugguucugguaccagugucucgagccucccgucaacugcaaggacuaggagcuggguugaggaucaaaauaggaauuugucaccuuucaugaggggggcccacaacauaucguuugucaccccaccaucuagcagacccucuagccaaggcacagucucaaccgugcccaaagaaguuuuggacuccuggacuggcgcuuucaauacgcgcaggcagccucucuucgcucacauucguaaacgaggggagucacgggcguaa

SEQ ID NO: 8738 - RNA, 807 nt, Artificial Sequence; identical to SEQ ID NO: 8620
  capsid_protein_VP2__Norovirus__AGE89656

SEQ ID NO: 8739 - RNA, 807 nt, Artificial Sequence
  capsid_protein_VP2__Norovirus__AGE89659
auggcuggagcuuucuuugcuggauuggcaucugauguccuugguucuggacuugguucccuaaucaaugcuggggcuggggccaucaaccaaaagauugacuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuagacuggagcggaacaagguacugggccccugaugcuaggaccacaacauacaaugcaggccgcuuuuccaccccucaaccuucggggacgcugccaggaagaaucaaucccaggaucccuacccccgcucggggcuccuccagcacaucuucuaaugcuucuacugcuacuucuauauauucaaaucaaacuguuucaacgagacuugguucugcagcugguucugguaccaaugucucgagucucccgucaacugcaaggacuaggagcuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8740 - RNA, 807 nt, Artificial Sequence
  capsid_protein_VP2__Norovirus__AGE89662
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuccaagcacaaauugaggccacuaaaaaguugcaacaggaaaugaugaaagucaagcaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccgcuuuuccaccccucaaccuucggggacgcugccaggaagaaucaaucccaggacuccuacccccgcucggggcuccuccaacacaucuucuaaugcuuccacugcuacuucuauacauucaaaucaaacuguuucaacgagacuugguucuacagcugguucugguaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8741 - RNA, 807 nt, Artificial Sequence; identical to SEQ ID NO: 8627
  capsid_protein_VP2__Norovirus__AGE89665

SEQ ID NO: 8742 - RNA, 807 nt, Artificial Sequence; identical to SEQ ID NO: 8740
  capsid_protein_VP2__Norovirus__AGE89668

SEQ ID NO: 8743 - RNA, 807 nt, Artificial Sequence
  capsid_protein_VP2__Norovirus__AGE89671
auggcuggagcuuucuuugcuggauuggcaucugauguccuuggcucuggacuugguucccuaaucaaugcuggggcuggggccaucaaccaaaagauugauuuugaaaauaauagaaaauugcagcaagcuuccuuccaguuuagcaguaaucuacaacaggcuuccuuucaacacgauaaagagaugcuucaagcacaaauugaggccacuaaaaaguugcaacaggaaaugaugaaagucaaacaggcaaugcuccuagaagguggauucucugaaacagaugcagcccguggggcaaucagcgcccccaugacaaagguuuuggacuggagcggaacaagguacugggccccugaugcuaggaccacaacauacaauucaggccgcuuuuccaccccccaaccuucggggacgcugccaggaagaaucaaucccaggacuccuacccccgcucggggcuccucuagcacaucuucuaaugcuucuacugcuacuucuauacauuuaaaucaaacuguuucaacgagacuugguucuacagcugguucuggcaccaaugucucgagucucccgucaacugcaaggacuaggaguuggguugaggaucaaaacagaaauuugucaccuuucaugaggggggcucauaacauaucguuugucaccccaccaucuagcagauccucuagccaaggcacagucucaaccgugccuaaagaaauuuuggacuccugggcuggcgcuuucaacacgcgcaggcagccucucuucgcucacauucguaggcgaggggagucacggguguaa

SEQ ID NO: 8744 - RNA, 807 nt, Artificial Sequence; identical to SEQ ID NO: 8740
  capsid_protein_VP2__Norovirus__AGE89674

SEQ ID NO: 8745 - RNA, 807 nt, Artificial Sequence
  capsid_protein_VP2__Norovirus__AGE99604
auggcuggagcuuucuuugcuggauuggcaucugauguccuuagcucuggacuugguucccuaaucaaugcuggggcuggggcuaucaaccaaaagauugauuuugaaaauaauagaaaauugcagcaagcuuccuuucaguuuagcagcaaucuacaacaagcuuccuuucaacaugauaaagagaugcuccaagcacaaauugaggccacuaaaaaguugcaacaggaacugaugaaagucaaacagacaauacucuuagaagguggauuuucugaaacagaugcagcccguggggcaaucaacgcccccaugacaaaggcuuuggacuggagugggacaagguacugggccccugaugcuaggacuacaacauacaaugcaggccgcuuuuccaccccucaaccuucgggggcacugccaggaagaaucaaucccaggacuccuauccccgcccggggcucccccagcauaucuuccaaugcuucuacugcuacuucuauacauucaaaucaaacugcuucaacgagacuugguucuacagcugguucuggcaccaaugucucgagucucccgucaacugcaaggacuaggaguuggguugaggaucaaaacagaaauuugucaccuuucaugaggggggcucacaacauaucguuugucaccccaccaucuagcagauccuccagccaaggcacagucucaaccgugccuaaagauguuuuggacuccuggacuggcgcuuucaacacgcgcaggcagccucucuucgcucacauucguaggcgaggggagucacggguguaa

SEQ ID NO: 8746 - RNA, 807 nt, Artificial Sequence
  capsid_protein_VP2__Norovirus__AGE99607
auggcuggaccuuucuuugcuggauuggcaucugauguccucgguucuggacuugguucucuaaucagugcuggagcuggagccaucaaucaaaaaguugaauuugaaaacaauagaaaauugcaacaagcuucuuuucaauucaguaguaaucugcaacaggcuuccuuccagcaugauaaagagaugcuccaagcacaaauugaggcuacucaaaaauugcagcaagaauugaugaaaguuaaacaggcagugcuccuagaggguggguuuuccacaacagaugcggcccguggggcaaucaacgcccccaugacaaaggcucuggacuggagcggaacaagguauugggcuccugaugccaggaucacaacauacaaugcaggccgcuucuccaccccucagccuuugggagcauugccugggagaaccaauccuaggguuccugcaucugcucggagcucccccaguucacuuuccaaugcuccuacugcuacuucuguguauuccaaucaaacugcuucaacgagacuagguucuucagcugguucuggugccggugucucaagucucccgucaacugcaaggacuaggagcuggguugaggaccaaaacaaaaauuugucgccuuucaugaagggggcucucaacacaucauuugugaccccuccaucuaguagauccuccaaccaaggcacagucucaaccgugccuaaagagauuuuggacuccuggacuggcgcuuuuaauacgcgcaggcagccucucuucgcacacauucguaagcgaggggagucacggguguaa

SEQ ID NO: 8747 - RNA, 807 nt, Artificial Sequence
  capsid_protein_VP2__Norovirus__AGK36312
auggcuggagcuuucuuugcuggauuggcaucugauguccuuggcucuggacuugguucccuaaucaaugcuggggcuggggccaucaaccaaaagauugauuuugaaaauaauagagaauugcagcaagcuuccuuccaguuuagcaguaaucuacaacaggcuuccuuucaacacgauaaagagaugcuccaagcacaaauugaggccacuaaaaaguugcaacaggaaaugaugaaagucaaacaggcaaugcuccuagaagguggauucucugaaacagaugcagcccguggggcaaucaacgcccccaugacaaagguuuuggacuggagcggaacaagguacugggccccugaugcuaggaccacaacauacaaugcaggccguuuuuccacuccucaaccuucggggacgcugccaggaagaaucaaucccaggacuccuacccccgcucggggcuccuccagcgcaucuucuaaugcuucuacugcuacuucuauauauucaaaucaaacuguuucaacgagacuugguucuacagcugguucugguaccaaugucucgagucucccgucaacugcaaggacuaggagcuggguugaggaucaaaacagaaauuugucaccuuucaugaggggggcucauaacauaucguuugucaccccgccaucuagcagauccucuagccaaggcacagucucaaccgugccuaaagaaguuuuggacuccuggacuggcgcuuucaacacgcgcaggcagccucucuucgcucacauucguaggcgaggggagucacggguguaa

SEQ ID NO: 8748 - RNA, 807 nt, Artificial Sequence
  capsid_protein_VP2__Norovirus__AGK36315
auggcuggagcuuucuuugcuggauuggcaucugacguccuuggcucuggacuugguucccuaaucaaugcuggggcuggggccaucaaccaaaaaguugaauuugaaaauaacagaaaauugcaacaagcuuccuuccaauuuaguagcaaucuacaacaggcuuccuuucaacaugacaaagagaugcuccaagcacaaauugaggccaccaaaaaguugcaacaggaaaugaugagaguuaaacaagcaaugcuccuagaggguggauucucugagacagaugcagcccguggggcaaucaacgcccccaugacaaaaacuuuggacuggagcgggacaagguacugggcucccgaugcuaggacaacaacauauaaugcaggccgcuuuuccaccccccaacccucgggggcacuaccaggaagagcuaaucuuagggcuacuguccccgcccgggguuccuccagcacguccucuaacucuucuauugcuacuucuguguauucaaaucaaaccaccucaacgagacuugguucuacagcugguucugguaccagugucucgagccucccgucaacugcaaggacuaggagcuggguugaggaucaaaauaggaauuugucaccuuucaugaggggggcccauaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8749 - RNA, 639 nt, Artificial Sequence
  capsid_protein_VP2__Norovirus__AGM33209
auggcccaagccauaauuggugcaauugcugcuuccacagcagguagugcucugggagcgggcauacagguugguggcgaagcggcccuccaaagccaaagguaucaacaaaauuugcaacugcaagaaaauucuuuuaaacaugacagggaaaugauuggguaucagguugaagcuucaaaucaauuauuggcuaaaaauuuggcaacuagauauucacuccuccgugcuggggguuugaccagugcugaugcagcaagaucuguggcaggagcuccagucacccguauuguagauuggaauggcgugagagugucugcucccgaguccucugcuaccacauugagauccgguggcuucaugucaguucccauaccauuugccucuaagcaaaaacagguucaaucaucugguauuaguaauccaaauuauuccccuucauccauuucucgaaccacuaguugggucgagucacaaaacucaucgagauuuggaaaucuuucuccauaccacgcggaggcucucaauacagugugguugacuccacccgguucaacagccucuucuacacugucuucugugccacgugguuauuucaauacagacagguugccauuauucgcaaauaauaggcgauga

SEQ ID NO: 8750 - RNA, 639 nt, Artificial Sequence
  capsid_protein_VP2__Norovirus__AGM33215
auggcccaagccauaauuggugcaauugcugcuuccacagcagguagugcucugggagcgggcauacagguugguggcgaagcggcccuccaaagccaaagguaucaacaaaauuugcaacugcaagaaaauucuuuuaaacaugacagggaaaugauuggguaucagguugaagcuucaaaucaauuauuggcuaaaaauuuggcaacuagauauucacuccuccgugcuggggguuugaccagugcugaugcagcaagaucuguggcaggaguuccagucacccgcauuguagauuggaauggcgugagagugucugcucccgaguccucugcuaccacauugagauccgguggcuucaugucaguucccauaccauuugccucuaagcaaaaacagguucaaucaucugguauuaguaauccaaauuauuccccuucauccauuucucgaaccacuaguugggucgagucacaaaacucaucgagauuuggaaaucuuucuccauaccacgcggaggcucucaauacagugugguugacuccacccgguucaacagccucuucuacacugucuucugugccacgugguuauuucaauacagacagguugccauuauucgcaaauaauaggcgauga

SEQ ID NO: 8751 - RNA, 639 nt, Artificial Sequence
  capsid_protein_VP2__Norovirus__AGM33218
auggcccaagccauaauuggugcaauugcugcuuccacagcagguagugcucugggagcgggcauacagguugguggcgaagcggcccuccaaagccaaagguaucaacaaaauuugcaacugcaagaaaauucuuuuaaacaugacagggaaaugauuggguaucagguugaagcuucaaaucaauuauuggcuaaaaauuuggcaacuagauauucacuccuccgugcuggggguuugaccagugcugaugcagcaagaucuguggcaggagcuccagucacccgcauuguagauuggaauggcgugagagugucugcucccgaguccucugcuaccacauugagauccgguggcuucaugucaguucccauaccauuugccucuaagcaaaaacagguucaaucaucugguauuaguaauccaaauuauuccccuucauccauuucucgaaccacuaguugggucgagucacaaaacucaucgagauuuggaaaucuuucuccauaccacgcggaggcucucaauacagugugguugacuccacccgguucaacagccucuucuacacugucuucugugccacgugguuauuucaauacagacagguugccauuauucgcaaauaauaggcgauga

SEQ ID NO: 8752 - RNA, 639 nt, Artificial Sequence; identical to SEQ ID NO: 8751
  capsid_protein_VP2__Norovirus__AGM33221

SEQ ID NO: 8753 - RNA, 639 nt, Artificial Sequence; identical to SEQ ID NO: 8750
  capsid_protein_VP2__Norovirus__AGM33224

SEQ ID NO: 8754 - RNA, 639 nt, Artificial Sequence; identical to SEQ ID NO: 8751
  capsid_protein_VP2__Norovirus__AGM33227

SEQ ID NO: 8755 - RNA, 639 nt, Artificial Sequence
  capsid_protein_VP2__Norovirus__AGM33230
auggcccaagccauaauuggugcaauugcugcuuccacagcagguagugcucugggagcgggcauacagguugguggcgaagcggcccuccaaagccaaagauaucaacaaaauuugcaacugcaagaaaauucuuuuaaacaugacagggaaaugauuggguaucagguugaagcuucaaaucaauuauuggcuaaaaauuuggcaacuagauauucacuccuccgugcuggggguuugaccagugcugaugcagcaagaucuguggcaggaguuccagucacccgcauuguagauuggaauggcgugagagugucugcucccgaguccucugcuaccacauugagauccgguggcuucaugucaguucccauaccauuugccucuaagcaaaaacagguucaaucaucugguauuaguaauccaaauuauuccccuucauccauuucucgaaccacuaguugggucgagucacaaaacucaucgagauuuggaaaucuuucuccauaccacgcggaggcucucaauacagugugguugacuccacccgguucaacagccucuucuacacugucuucugugccacgugguuauuucaauacagacagguugccauuauucgcaaauaauaggcgauga

SEQ ID NO: 8756 - RNA, 639 nt, Artificial Sequence
  capsid_protein_VP2__Norovirus__AGM33233
auggcccaagccauaauuggugcaauugcugcuuccacagcagguagugcucugggagcgggcauacagguugguggcgaagcggcccuccaaagccaaagguaucaacaaaauuugcaacugcaagaaaauucuuuuaaacaugacagggaaaugauuggguaucagguugaagcuucaaaucaauuauuggcuaaaaauuuggcaacuagauauucacuccuccgugcuggggguuugaccagugcugaugcagcaagaucuguggcaggaguuccagucacccgcauuguagauuggaauggcgugagagugucugcucccgaguccucugcuaccacauugagauccgguggcuucaugucaguucccauaccauuugccucuaagcaaaaacagauucaaucaucugguauuaguaauccaaauuauuccccuucauccauuucucgaaccacuaguugggucgagucacaaaacucaucgagauuuggaaaucuuucuccauaccacgcggaggcucucaauacagugugguugacuccacccgguucaacagccucuucuacacugucuucugugccacgugguuauuucaauacagacagguugccauuauucgcaaauaauaggcgauga

SEQ ID NO: 8757 - RNA, 639 nt, Artificial Sequence; identical to SEQ ID NO: 8751
  capsid_protein_VP2__Norovirus__AGM33236

SEQ ID NO: 8758 - RNA, 639 nt, Artificial Sequence; identical to SEQ ID NO: 8751
  capsid_protein_VP2__Norovirus__AGM33239

SEQ ID NO: 8759 - RNA, 639 nt, Artificial Sequence; identical to SEQ ID NO: 8751
  capsid_protein_VP2__Norovirus__AGM33242

SEQ ID NO: 8760 - RNA, 639 nt, Artificial Sequence
  capsid_protein_VP2__Norovirus__AGM33245
auggcccaagccauaauuggugcaauugcugcuuccacagcagguagugcucugggagcgggcauacagguugguggcgaagcggcccuccaaagccaaagguaucaacaaaauuugcaacugcaagaaaauucuuuuaaacaugacagggaaaugauuggguaucagguugaagcuucaaaucaauuauuggcuaaaaauuuggcaacuagauauucacuccuccgugcuggggguuugaccagugcugaugcagcaagaucuguggcaggaguuccagucacccgcauuguagauuggaauggcgugagagugucugcucccgaguccucugcuaccacauugagauccgguggcuucaugucaguucccauaccauuugccucuaagcaaaagcagguucaaucaucugguauuaguaauccaaauuauuccccuucauccauuucucgaaccacuaguugggucgagucacaaaacucaucgagauuuggaaaucuuucuccauaccacgcggaggcucucaauacagugugguugacuccacccgguucaacagccucuucuacacugucuucugugccacgugguuauuucaauacagacagguugccauuauucgcaaauaauaggcgauga

SEQ ID NO: 8761 - RNA, 639 nt, Artificial Sequence; identical to SEQ ID NO: 8751
  capsid_protein_VP2__Norovirus__AGT17786

SEQ ID NO: 8762 - RNA, 639 nt, Artificial Sequence; identical to SEQ ID NO: 8751
  capsid_protein_VP2__Norovirus__AGT17793

SEQ ID NO: 8763 - RNA, 807 nt, Artificial Sequence
  capsid_protein_VP2__Norovirus__AGT17796
auggcuggagccuucuuugcuggauuggcaucugacguccuuggcucuggacuugguucccuaaucaaugcuggggcuggggccaucaaccaaaaagucgaauuugaaaauaacagaaaauugcaacaagcuuccuuccaauuuaguagcaaucuacaacaggcuuccuuucaacaugacauagagaugcuccaagcacaaauugaggccaccaaaaaguugcaacaggaaaugaugagagcuaaacaagcaaugcuccuagaggguggauucucugagacagaugcagcccguggggcaaucaacgcccccaugacaaaaacuuuggacuggagcggaacaagguacugggcucccgaugcuaggacuacaacauacaaugcaggccgcuuuuccaccccucaacccucgggggcacaaccaggaagggcuaaucuuagggcuacuguccccgcccgggguuccuccagcacgucuucuaacucuucuauugcuacuucuguguauucaaaucaaacuaccucaacgagacuugguucuacagcugguucugguaccagugucucgagccuuccgucaacugcaaggaccaggagcuggguugaggaucaaaauaggaauuugucaccuuucaugaggggggcccacaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8764 - RNA, 807 nt, Artificial Sequence
  capsid_protein_VP2__Norovirus__AGT17799
auggcuggagcuuucuuugcuggauuggcaucugacguccuuggauccggacuugguucucugaucaaugccggggcuggggccaucaaccaaaaaguugaauuugaaaacaacagaaaauugcaacaagauuccuuccaauuuaguagcaaucugcaacaggcuuccuuucaacaugauaaagagaugcuccaagcacaaauugaggccaccaaaaaguugcaacaggaaaugaugagaguuaaacaggcaaugcuccuagaggguggguucucugagacagaugcagcccguggggcaaucaacgcccccaugacaaagguuuuggacuggagugggacaagguacugggcucccggugcuaggacuacaacauacaaugcaggcuacuuuuccacuccccaacacucgggggcacugccaggaagagcuaaucuuagggcuguuguccccgcucggggcuccucuagaguaucuucuaauucuucuacugcuaccucuguguauucaaaucaaacugcuucaacgagacuugguucuacagcugguucugguaccagugucucgagccucccgucaacugcaaggacuaggaguuggguugaggaucaaaauaggaauuugucaccuuucaugaggggggcccacaacauaucguuugucaccccaccaucuagcagauccucuagucaaggcacagucucaaccgugcccaaagaaguuuugaacucccaggcuggcguuuucaauacgcgcaggcagccucucuuugcucacauucguaggcgaggggagucacgggcguaa

SEQ ID NO: 8765 - RNA, 639 nt, Artificial Sequence; identical to SEQ ID NO: 8751
  capsid_protein_VP2__Norovirus__AGT17804

SEQ ID NO: 8766 - RNA, 639 nt, Artificial Sequence; identical to SEQ ID NO: 8751
  capsid_protein_VP2__Norovirus__AGT17807

SEQ ID NO: 8767 - RNA, 639 nt, Artificial Sequence; identical to SEQ ID NO: 8751
  capsid_protein_VP2__Norovirus__AGT17810

SEQ ID NO: 8768 - RNA, 807 nt, Artificial Sequence
  capsid_protein_VP2__Norovirus__AGT17814
auggcuggagcuuucuuugcuggauuggcaucugacguccucggcucuggacuugguucccuaaucaaugcuggggcuggggccaucaaccaaaaaguugaauuugaaaauaacagaaaauugcaacaagcuuccuuccaauuuagcagcaaucuacaacaggcuuccuuucaacaugauaaagagaugcuccaaucacaaauugaugccaccaaaaaguugcaacaggaaaugaugagaguuaaacaagcaaugcuccuagaggguggguucucugagacagaugcagcccguggggcaaucaacgcccccaugacaaaaguuuuggacuggagcgggacaagguacugggcucccgaugcuaggacuacaacauauaaugcaggccgcuuuuccaccccucaacccucgggggcaccaccuggaagagcuaaucuuagggcugcuguccccgcccgggguuccuccagcacaucuucuaacucuucuauugcuacuucuauguauucaaaucaaaccacuucaacgagacuugguucuacagcugguucugguaccagugucucgagccucccgucaucugcaaggacuaggagcuggguugaggaucaaaauaggaauuugucaccuuucaugaggggggcccacaacaucucguuugucaccccaccaucuagcagauccucuagccaaggcacagucucaaccgugcccaaagaaguuuuggacuccuggacuggcgcuuucaauacgcgcaggcagccucucuucgcucacauccguaggcgaggggagucacggguguaa

SEQ ID NO: 8769 - RNA, 807 nt, Artificial Sequence
  capsid_protein_VP2__Norovirus__AGT17820
auggcuggagccuucuuugcuggauuggcaucugacguccuuggcucuggacuugguucccuaaucaaugcuggggcuggggccaucaaccaaaaagucgaauuugaaaauaacagaaaauugcaacaagcuuccuuccaauuuaguagcaaucuacaacaggcuuccuuucaacaugacaaagagaugcuccaagcacaaaucgaggccaccaaaaaguugcaacaggaaaugaugagagcuaaacaagcaaugcuccuagaggguggauucucugagacagaugcagcccguggggcgaucaacgcccccaugacaaaaacuuuggacuggagcggaacaagguacugggcucccgaugcuaggacuacaacauacagugcaggccgcuuuuccaccccucagcccucgggggcacuaccaggaagagcuaaucuuagggcuacuguccccgcccgggguuccuccagcacgucuucuaacucuucuauugcuacuucuguguauucaaaucaaacuaccucaacgagacuugguucuacagccgguucugguaccagugucucgagccuuccgucaacugcaaggaccaggagcuggguugaggaucaaaauaggaauuugucaccuuucaugaggggggcccacaacaucucguuugucaccccaccaucuaguagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8770 - RNA, 807 nt, Artificial Sequence
  capsid_protein_VP2__Norovirus__AGT17824
auggcuggagcuuucuuugcuggauuggcaucugacguccuuggauccggacuugguucucugaucaaugccggggcuggggccaucaaccaaaaaguugaauuugaaaacaacagaaaauugcaacaagauuccuuccaauuuaguagcaaucugcaacaggcuuccuuucaacaugauaaagagaugcuccaagcacaaauugaggccaccaaaaaguugcaacaggaaaugaugagaguuaaacaggcaaugcuccuagaggguggguucucugagacagaugcagcccguggggcaaucaacgcccccaugacaaagguuuuggacuggagugggacaagguacugggcucccgaugcuaggacuacaacauacaaugcaggccacuuuuccacuccucaacacucgggggcacugccaggaagagcuaaucuuagggcuacuguccccgcucggggcuccucuagagcaucuucuaauucuucuacugcuaccucuguguacucaaaucaaacuacuucaacgagacuugguucuacagcugguucugguaccagugucucgagccucccgucaacugcaaggacuaggaguuggguugaggaucaaaauaggaauuugucaccuuucaugaggggggcccacaacauaucguuugucaccccaccaucuagcagauccucuagccaaggcacagucucaaccgugcccaaagaaguuuugaacucccggacuggcgcuuucaauacgcgcaggcagccucucuucgcucacauucguaggcaaggggagucacgggcguaa

SEQ ID NO: 8771 - RNA, 639 nt, Artificial Sequence; identical to SEQ ID NO: 8751
  capsid_protein_VP2__Norovirus__AGT17827

SEQ ID NO: 8772 - RNA, 807 nt, Artificial Sequence
  capsid_protein_VP2__Norovirus__AGT17831
auggcuggagcuaucauugcuggauuggcaucugauguccuuagcucuggacuugguucccuaaucaaugcuggggcuggggucaucaaccaaaaagucgauuuugaaaauaauaaacaacugcaacaaaacuccuuccaauuuagcagcaaucuacaacaggcuuccuuucaacaugauaaagagaugcuccaagcacaaauugaggccaccaaaaaguugcaacaggagaugaugggaaucaaacaggcaguacuccuaaaggguggguucucugagacagaugcagcccguggggcagucaacgcccccaugacaaagguuuuggacuggaguggaacaagguacugggcucccaaugcuagcaccacaacauacaaugcaggccgcuuuuccaccccccagcccucgggggcguugccaggaagaacuaaucucaggacugcugcccccgcucggggcucccccagcauaucuucuaaugcuucuacugcuacuucugucuauucaaaucaaacuguuucaacgagacuugguacuucagcugguucugguaccagugucucgagccucccgucaacugcgaggacuaggagcuggguugaggaucaaaacaggaauuugucaccuuucaugagaggggcucacaacauaucguuuguuaccccaccaucuagcagauccucuagccaaggcacagucucaaccgugccuaaagaaguuuuggacuccuggacuggcgccuucaacacgcgcaggcagccucucuucgcucacauucguaagcgaggggagucacggguauaa

SEQ ID NO: 8773 - RNA, 639 nt, Artificial Sequence; identical to SEQ ID NO: 8751
  capsid_protein_VP2__Norovirus__AGT17837

SEQ ID NO: 8774 - RNA, 807 nt, Artificial Sequence
  capsid_protein_VP2__Norovirus__AGT17843
auggcuggagcuuucuuugcuggauuggcaucugacguccuuggauccggacuugguucucugaucaaugccggggcuggggccaucaaccaaaaaguugaauuugaaaacaacagaaaauugcaacaagauuccuuccaauuuaguagcaaucugcaacaggcuuccuuucaacaugauaaagagaugcuccaagcacaaauugaggccaccaaaaaguugcaacaggaaaugaugagaguuaaacaggcaaugcuccuagaggguggguucucugagacagaugcagcccguggggcaaucaacgcccccaugacaaagguuuuggacuggaaugggacaagguacugggcucccggugcuaggacuacaacauacaaugcaggccacuuuuccacuccccaacacucgggggcacugccaggaagagcuaaucuuagggcugcuguccccgcucggggcuccucuagagcaucuucuaauucuucuacugcuaccucuguguauucaaaucaaacuacuucaacgagacuugguucuacagcugguucugguaccagugucucgagccucccgucaacugcaaggacuaggaguuggguugaggaucaaaauaggaauuugucaccuuucaugaggggggcccacaacauaucguuugucaccccaccaucuagcagauccucuagccaaggcacagucucaaccgugcccaaagaaguuuugaacucccagacuggcgcuuucaauacgcgcaggcagccucucuuugcucacauucguaggcgaggggagucacgggcguaa

SEQ ID NO: 8775 - RNA, 807 nt, Artificial Sequence
  capsid_protein_VP2__Norovirus__AGX85887
auggcuggagcuuucuuugcuggauuggcaucugacguccucagcucuggacuugguucccuaaucaaugcuggggcuggggccaucaaccaaacaguugaauuugaaaauaacagaaaauugcaacaagcuuccuuccaauuuagcagcaaucuacaacaggcuuccuuucaacaugauaaagagaugcuccaaucacaaauugaugccaccaaaaaguugcaacaggaaaugaugagaguuaaacaagcaaugcuccuagaggguggguucucugagacagaugcagcccguggggcaaucaacgcccccaugacaaaaguuuuggacuggagcgggacaagguacugggcucccgaugcuaggacuacaacauauaaugcaggccgcuuuuccaccccucaauccucgggggcaccaccuggaagagcuaaucuuagggcugcuguccccgcccaggguuccuccagcacaucuucuaacucuucuauugcuacuucuauguauucaaaucaaaccacuucaacgagacuugguucuacagcugguucugguaccagugucucgagccucccgucaucugcaaggacuaggagcuggguugaggaucaaaauaggaauuugucaccuuucaugaggggggcccacaacaucucguuugucaccccaccaucuagcagauccucuagccaaggcacagucucaaccgugcccaaagaaguuuuggacuccuggacuggcgcuuucaauacgcgcaggcagccucucuucgcucacauccguaggcgaggggagucacggguauaa

SEQ ID NO: 8776 - RNA, 807 nt, Artificial Sequence
  capsid_protein_VP2__Norovirus__AGX85893
auggcuggagcuuucuuugcuggauuggcaucugacguccuuggauccggacuugguucucugaucaaugccggggcuggggccaucaaccaaaaaguugaauuugaaaacaacagaaaauugcaacaagauuccuuccaauuuaguagcaaucugcaacaggcuuccuuucaacaugauaaagagaugcuccaagcacaaauugaggccaccaaaaaguugcaacaggaaaugaugagaguuaaacaggcaaugcuccuagaggguggguucucugagacagaugcagcccguggggcaaucaacgcccccaugacaaagguuuuggacuggagugggacaagguacugggcucccggugcuaggacuacaacauacaaugcaggcuacuuuuccacuccccaacacucgggggcacugccaggaagagcuaaucuuagggcugcuguccccgcucggggcuccucuagaguaucuucuaauucuucuacugcuaccucuguguauucaaaucaaacugcuucaacgagacuugguucuacagcugguucugguaccagugucucgagccucccgucaacugcaaggacuaggaguuggguugaggaucaaaauaggaauuugucaccuuucaugaggggggcccacaacauaucguuugucaccccaccaucuagcagauccucuagucaaggcacagucucaaccgugcccaaagaaguuuugaacucccagacuggcguuuucaauacgcgcaggcagccucucuuugcucacauucguaggcgaggggagucacgggcguaa

SEQ ID NO: 8777 - RNA, 807 nt, Artificial Sequence
  capsid_protein_VP2__Norovirus__AGX85896
auggcuggagcuuucuuugcuggauuggcaucugacguccuuggauccggacuugguucucugaucaaugccggggcuggggccaucaaccaaaaaguugaauuugaaaacaacagaaaauugcaacaagauuccuuccaauuuaguagcaaucugcaacaggcuuccuuucaacaugauaaagagaugcuccaagcacaaauugaggccaccaaaaaguugcaacaggaaaugaugagaguuaaacaggcaaugcuccuagaggguggguucucugagacagaugcagcccguggggcaaucaacgcccccaugacaaagguuuuggacuggagugggacaagguacugggcucccggugcuaggacuacaacauacaaugcaggcuacuuuuccacuccccaacacucgggggcacugccaggaagagcuaaucuuagggcugcuguccccgcucggggcuccucuagaguaucuucuaauucuucuacugcuaccucuguguauucaaaucaaacugcuucaacgagacuugguucuacagcugguucugguaccagugucucgagccucccgucaacugcaaggacuaggaguuggguugaggaucaaaauaggaauuugucaccuuucaugaggggggcccacaacauaucguuugucaccccaccaucuagcagauccucuagccaaggcacagucucaaccgugcccaaagaaguuuugaacucccagacuggcgcuuucaauacgcgcaggcagccucucuuugcucacauucguaggcgaggggagucacgggcguaa

SEQ ID NO: 8778 - RNA, 807 nt, Artificial Sequence
  capsid_protein_VP2__Norovirus__AGX85905
auggcuggagcuuucuuugcuggauuggcaucugauguccuuagcucuggacuugguucccuaaucaaugcuggggcuggggcuaucaaccaaaggauugauuuugaaaauaauagaaaauugcagcaagcuuccuuucaguuuaguaguaaucuacaacaagcuuccuuucaacaugauaaagagaugcuccaagcacaaauugaggcuacuaaaaaguugcaacaggaacugaugaaagucaaacaggcaaugcucuuagaagguggauucucugaaacagaugcagcccguggggcaaucaacgcccccaugacaaaggcuuuggacuggaguggaacaagguacugggccccugaugcuaggacuacaacauacaaugcaggccgcuuuucuaccccucaaccuucgggggcacugccaggaagaaucaaccccaggacuccuauccccgcccggggcuccccaagcauaucuuccaauguuucuacugcuaauucuauacauucaaaucaaacugcuucaacgagacuugguucuacagcugguucuggcaccgaugucucgagucucccgucaacugcaaggacuaggaguuggguugaggaucaaaacagaaauuuaucaccuuucaugaggggggcucacaacauaucguuugucaccccaccaucuagcagauccuccagccaaggcacagucucaaccgugccuaaagauguuuuggacuccuggacuggcgcuuucaacacgcgcaggcagccucucuucgcucacauucguaggcgaggggagucacggguguaa

SEQ ID NO: 8779 - RNA, 807 nt, Artificial Sequence
  capsid_protein_VP2__Norovirus__AGX85914
auggcuggagcuuucuuugcuggauuggcaucugacguccuuggauccggacuugguucucugaucaaugccggggcuggggccaucaaccaaaaaguugaauuugaaaacaacagaaaauugcaacaagauuccuuccaauuuaguagcaaucugcaacaggcuuccuuucaacaugauaaagagaugcuccaagcacaaauugaggccaccaaaaaguugcaacaggaaaugaugagaguuaaacaggcaaugcuccuagaggguggguucucugagacagaugcagcccguggggcaaucaacgcccccaugacaaagguuuuggacuggagugggacaagguacugggcucccggugcuaggacuacaacauacaaugcaggcuacuuuuccacuccccaacacucgggggcacugccaggaagagcuaaucuuagggcuguuguccccgcucggggcuccucuagaguaucuucuaauucuucuacugcuaccucuguguauucaaaucaaacugcuucaacgagacuugguucuacagcugguucugguaccagugucucgagccucccgucaacugcaaggacuaggaguuggguugaggaucaaaauaggaauuugucaccuuucaugaggggggcccacaacauaucguuugucaccccaccaucuagcagauccucuagucaaggcacagucucaaccgugcccaaagaaguuuugaacucccagacuggcguuuucaauacgcgcaggcagccucucuuugcucacauucguaggcgaggggagucacgggcguaa

SEQ ID NO: 8780 - RNA, 807 nt, Artificial Sequence; identical to SEQ ID NO: 8775
  capsid_protein_VP2__Norovirus__AGX85917

SEQ ID NO: 8781 - RNA, 807 nt, Artificial Sequence
  capsid_protein_VP2__Norovirus__AGX85923
auggcuggagcuaucauugcuggauuggcaucugauguccuuagcucuggacuugguucccuaaucaaugcuggggcuggggucaucaaccaaaaagucgauuuugaaaauaauaaacaacugcaacaaaacuccuuccaauuuagcagcaaucuacaacaggcuuccuuucaacaugauaaagagaugcuccaagcacaaauugaggccaccaaaaaguugcaacaggaaaugaugggaaucaaacaggcaguacuccuaaaggguggguucucugagacagaugcagcccguggggcagucaacgcccccaugacaaagguuuuggacuggaguggaacaagguacugggcucccaaugcuagcaccacaacauacaaugcaggccgcuuuuccaccccccagcccucgggggcguugccaggaagaacuaaucucaggacugcugcccccgcucggggcucccccagcauaucuucuaaugcuucuacugcuacuucugucuauucaaaucaaacuguuucaacgagacuugguacuucagcugguucugguaccagugucucgagccucccgucaacugcgaggacuaggagcuggguugaggaucaaaacaggaauuugucaccuuucaugagaggggcucacaacauaucguuuguuaccccaccaucuagcagauccucuagccaaggcacagucucaaccgugccuaaagaaguuuuggacuccuggacuggcgccuucaacacgcgcaggcagccucucuucgcucacauucguaagcgaggggagucacggguauaa

SEQ ID NO: 8782 - RNA, 807 nt, Artificial Sequence
  capsid_protein_VP2__Norovirus__AGX85926
auggcuggagcuaucauugcuggauuggcaucugacguccuuagcucuggacuugguucccuaaucaaugcuggggcuggggccaucaaccaaacaauugauuuugaaaauaacagaaaauugcaacaagcuuccuuccaguuuaguagcaaucuacaacaggcuuccuuucaacaugacaaagagaugcuccaagcacaaauugaggccaccaaaaaguugcaacaggaaaugaugagaguuaaacaagcaaugcuccuagaggguggguucucugagacagaugcagcccgcggggcaaucaacgcccccaugacaaaaacuuuggacuggagcggaacaagguacugggcucccgaugcuaggacuacaacauauaaugcaggccgcuuuuccaccccccaacccucgggggcaccaccaggaagagcuaaucuuagggcuacuacccccgcccgggguuccucuagcacaucuucuaauucuucuauugcuacuucuguguauucaaaucaaaccaccucaacgagacuugguucuacagcugguucugguaccagugucucgagccucccgucaacugcaaggacuaggaguuggguugaggaucaaaauaggaauuugucaccuuucaugaggggggcccauaacaucucguuugucaccccaccaucuagcagauccucuagccaaggcacagucucaaccgugcccaaagaaguuuuggacuccuggacuggcgcuuucaacacgcgcaggcagccucucuucgcucacauucguacgcgaggggagucacggguguaa

SEQ ID NO: 8783 - RNA, 807 nt, Artificial Sequence; identical to SEQ ID NO: 8779
  capsid_protein_VP2__Norovirus__AGX85932

SEQ ID NO: 8784 - RNA, 807 nt, Artificial Sequence; identical to SEQ ID NO: 8779
  capsid_protein_VP2__Norovirus__AGX85935

SEQ ID NO: 8785 - RNA, 780 nt, Artificial Sequence
  capsid_protein_VP2__Norovirus__AHI59155
auggcuagugcuuuucuugcaggucuugcuggcgacgucauaacaaauggcguuggaucucuaauaaaugcuggagcuaaugcagucaaucagaaaguugaauaugauuuuaauaaacagcuucaaauggcaucauuuaaacaugauaaagagauguugcaaucacaaguguuggcaaccaagcaguugcagcaggagaugaugaacauaaggcaggggguguugacugcuggcggcuucucccccgcggaugcugcuagaggggccgucaaugccccaaugacaaagauucuggacuggaauggcaccagguauugggcaccaaauagcaugaaaaccacaaguuauucaggacaguuuucuagcagcccuguucacaaguccccugcuccuucucagcacacugcuuugccaaagaguagauugcaaaaugauuuugcuaguguauauaguuucccuuccucuguuucuucacaaucaacccauucaacagcgcugucagcaggaaccgggucuuccagguccaucuccccauccacagcgaccccuaccuugucuagaaccagcgacuggguuaggggacagaaugagaggcucagcccguuuauggauggugcucuccaaacugccuuugucacaccuccaucgagcaaagcuucuucaaaugguacggucucaaccguucccaaagcuguuuuggacuccuggaccccuauguuuaacacacauaggcagccucucuucgcccacccacguaggcgaggggagucacaaguuuag

SEQ ID NO: 8786 - RNA, 807 nt, Artificial Sequence
  capsid_protein_VP2__Norovirus__AHI59158
auggcuggagcuuucuuugcuggauuggcaucugacguccuuggcucuggacuugguucccuaaucaaugcuggggcuggggccaucaaccaaaaaguugaauuugaaaauaacaggaaauugcaacaagcuuccuuccaauuuaguagcaaucuacaacaggcuuccuuucaacaugacaaagagaugcuccaagcacaaauugaggccaccaaaaaguugcaacaagaaaugaugagaguuaaacaagcaaugcuccuagaggguggauucucugagacagaugcagcccguggggcaaucaacgcccccaugacaaaaacuuuggacuggagcgggacaagguacugggcucccgaugcuaggacuacaacauauaaugcaggccgcuuuuccaccccccaacccucgggggcacuaccaggaagagcuaaucuuagggcuaccguccccgcccgggguuccuccaacacgucuucaagcucuucuauugcuacuucuguguauucaaaucaaaccaccucaacgagacuugguucuacagcugguucugguaccagugucucgagccucccgucaacugcaaggacuaggaguuggguugaggaucaaaauaggaauuugucaccuuucaugaggggggcccacaacaucucguuugucaccccaccaucuagcagauccucuagccaaggcacagucucaaccgugcccaaagaaguuuuggacuccuggacuggcgcuuucaacacgcgcaggcagccucucuucgcucacauucguaagcgaggggagucacggguguaa

SEQ ID NO: 8787 - RNA, 780 nt, Artificial Sequence
  capsid_protein_VP2__Norovirus__AHI59160
auggcuggagccuuuguagcuggucuugcaggggacgugcucagcaaugggcucaguucauuaauuaaugcaggugccaaugcaauaaaucagagggcagaauuugauuuuaaucagaaauuacagcaaaauucuuucaaucaugauaaggagauguugcaggcccagauccaggcaacuaagcagcugcaggcagacaugauggcuauaaaacaggggguccugacagcuggcggcuuuuccccugcugaugcagccagaggugcugugaaugcgcccaugacacaggcgcuggauuggaacggcacaagguauugggcaccaggcucuaugaggaccacaucuuauucuggaaaauuuacaucaaccgccccagugaggcaggccgacuuccagcacacccaaagccggccuucgagugguucuucuguguccuccuuugccacucagucuucaaggccaacucugaccacaaccacuggguccucacauggcacagccucaucaaauucaacucgcagcacaagccucucccaaucaacggucucuagagcuacaucuaggacuagugaguggguuagagaucaaaauagaaauuuggaacccuacaugcauggugccuuacagacggccuuugucaccccaccuuccagcagggcgucugacgggacagucucaaccgucccaaaagguguuuuggacuccuggacaccugcguucaacacccgcaggcagccgcucuuugcacaccuccguaagaggggggagucacaugcuuag

SEQ ID NO: 8788 - RNA, 807 nt, Artificial Sequence
  capsid_protein_VP2__Norovirus__AHI59163
auggcuggagcuuucuuugcuggauuggcaucugacguccuuggcucuggacuugguucccuaaucaaugcuggggccggggccaucaaccaaaaaguugaauuugaaaauaacaggaaauugcaacaagcuucuuuccaauuuagcagcaaucuacaacaggcuuccuuucaacaugacaaagagaugcuccaagcacaaauugaggccaccaaaaaguugcaacaggaaaugaugagaguuaaacaagcaaugcuccuagaggguggauucucugagacagaugcagcccguggggcaaucaacgcccccaugacaaaaacuuuggacuggagcgggacaagguacugggcucccgaugcuaggauuacaacauauaaugcaggccgcuuucccaccccucaacucucgggggcacugccaggaagagcaaaucuuagggcuacuguccccgcccggggcucccccagcacgucuucuaacucuucuauugcuacuucuguguauucaaaucaaaccaccucaacgagacuugguucuacagcugguucugguaccagugucucgagccucccgucaacugcaaggacuaggagcuggguugaggaucaaaauaggaauuugucaccuuucuugaggggggcucacaacaucucguuugucaccccaccaucuagcagauccucuagccaaggcacagucucaaccgugcccaaagaaguuuuggacuccuggacuggcgcuuucaacacgcgcaggcagccucucuucgcucacauucguaagcgaggggagucacggguguaa

SEQ ID NO: 8789 - RNA, 807 nt, Artificial Sequence
  capsid_protein_VP2__Norovirus__AHI59166
auggcuggagcuuucuuugcuggauuggcaucugauguccuuggcucuggacuugguucccuaaucaaugcuggggcuggggccaucaaccaaaaaguugaauuugaaaauaacagaaaauugcaacaagcuucuuuccaauuuaguagcaaucugcaacaggcuuccuuccaacaugauaaggagaugcuccaagcacaaauugaggccacuaagaaauugcaacagggcaugaugaagguuaaacaggcgaugcuccuagaggguggauucucugaaacagaugcagcccguggggcaauuaacgcccccaugacaaaggcucuggacuggagcggaacaagguacugggcuccugaugccaggaccacaacauacaaugcaggccgcuuuuccaccccucaaccuucgggggcauugccagggagaaauaaccuuagggccacuguccccgcucggggcuccucuagcacacuuucuagcauucccacugcuacuucuguguauucaaaucaaacuguuucaacgagacuugguucuucagcugguucuggcaccagugucucgagucuuccgucaacugcaaggacuaggagcuggguugaggaucaaaacaaaaauuugucaccuuucaugaggggggcucucaacacaucauucgucaccccaccaucuaguagauccucuagccaaggcacagucucaaccgugccuaaagaaauuuuggacuccuggacuggcgcuuucaacacgcgcaggcagccucucuucgcucacguucgcaagcgaggggagucacggguguaa

SEQ ID NO: 8790 - RNA, 807 nt, Artificial Sequence
  capsid_protein_VP2__Norovirus__AHX22026
auggcuggagcuuucuuugcuggauuggcaucugacguccuuggcucuggacuugguucccuaaucaaugcuggggcuggggcuaucaaccaaaagguugaauuugaaaacaacagaaaacugcaacaagcuuccuuccaauuuagcagcaaucuacaacaggcuuccuuucaacaugacaaagagaugcuucaagcacaaauugaggccaccaaaaaguugcaacaggaaaugaugagagucaaacaaguaaugcuccuagaggguggauucucugagacagaugcagcccguggggcaaucaacgcccccaugacaaaagcuuuggacuggagcgggacaagguacugggcucccgaugcuaggacuacaacauauaaugcaggccgcuuuuccaccccucaacccucgggggcacugccaggaagagcuaaucuuaggguuacugcccccgcccgggguuccuccagcacgucuucuaacucuucuauugcuacuucuguguauucaagucaaaccacuucaacgagacuugguucuacagcugguucugguaccagugucucgagucucccuucaacugcaaggacuaggagcuggguugaggaucaaaauaggaauuuaucaccuuucaugaggggggcccacaacaucucguucgucaccccaccaucuagcagauccucuagccaaggcacagucucaaccgugcccaaagaaguuuuggacuccuggacuggcgcuuucaacacgcgcaggcagccucucuucgcucauauucgcaagcgaggggagucacggguguaa

SEQ ID NO: 8791 - RNA, 807 nt, Artificial Sequence
  capsid_protein_VP2__Norovirus__AHX22029
auggcuggagcuuucuuugcuggauuggcaucugauguccuuggcucuggacuugguucccuuaucaaugcuggggcuggggccaucaaccaaaaaguugaguuugaaaauaacagaaaauugcaacaagcauccuuccaauuuagcaguaaucuacaacaggcuuccuuucaacaugacaaagagaugcuccaagcacaaauugaggccaccaaaaagcuacaacaggaaaugaugaaaguuaagcagguaaugcuccuagaggguggguucucugagacagaugcagcccgcggggcaaucaacgcccccaugacaaaagcuuuggacuggagcgggacaagauacugggcucccgaugcuaggacuacaacauacaaugcaggccgcuuuuccaccccucaaccaucggggguacugccaggaagagccaaccuuagggaugcugucccugcucgggguuccuccagcaaaucuucuaacucuuuuacugcuacuucuguguacucaaaucaaacuacuucaacgagacuugguucuacagcuggcucugguaccagugucucgagccucccgucaacugcaaggacuaggagcuggguugaggaucaaaguaggaaugugucaccuuucaugaggggggcccacaacauaucguuugucaccccaccaucuagcagauccuccagccaaggcacagucucaaccgugccuaaagagguuuuggacuccuggacuggugcuuucaacacgcgcaggcagccacucuucgcucacauucguaagcgaggggagucacggguguaa

SEQ ID NO: 8792 - RNA, 807 nt, Artificial Sequence
  capsid_protein_VP2__Norovirus__AHX22033
auggcuggagcuuucuuugcuggauuggcaucugacguccuuggcucuggacuugguucccuaaucaaugcuggggcuggggccaucaaccaaaaaguugaauuugaaaacaacagaaaacugcaacaagcuuccuuccaauuuagcagcaaucuacaacaggcuuccuuucaacaugacaaagagaugcuucaagcacaaauugaggccaccaaaaaguugcaacaggaaaugaugagaguuaaacaaguaaugcuccuagaggguggauucucugagacagaugcagcccguggggcaaucaacgcccccaugacaaaagcuuuggacuggagcgggacaagguacugggcucccgaugcuaggacuacaacauauaaugcaggccgcuuuuccaccccucaacccucgggggcacuaucaggaagagcuaaucuuagggcuacugcccccgcccgggguuccuccaguacgucuucuaacucuucuauugcuacuucuguguauucaaaucaaaccaccucaacgagacuugguucuacagcugguucugguaccagugucucgagccccccgucaacugcaaggacuaggagcuggguugaggaucaaaacaggaauuuaucaccuuucaugaggggggcccacaacaucucauuugucaccccaccaucuagcagauccucuagccaaggcacagucucaaccgugcccaaagaaguuuuggacuccuggacuggcgcuuucaacacgcgcaggcagccucucuucgcucauauucgcaagcgaggggagucacggguguaa

SEQ ID NO: 8793 - RNA, 807 nt, Artificial Sequence
  capsid_protein_VP2__Norovirus__AHX22036
auggcuggggccuucuuugccggauuggcaucugacguccuuggcucuggacuugguucccuaaucaaugcuggggcuggggccaucaaccaaaaaguugaauuugaaaacaacagaaaauugcaacaagccuccuuccaauuuaguagcaaucuacaacaggcuuccuuucaacaugacaaagagaugcuccaagcacaaauugaggccaccaaaaaguugcaacaggaaaugaugagaguuaaacaagcaaugcuccuagaggguggauucucugagacagaugcagcccguggggcaaucaacgcccccaugacaaaaacuuuggacuggagcggaacaagguacugggcucccgaugcuaggacuacaacauacaaugcaggccgcuuuuccaccccucaacccucgggggcacuaccaggaagagcuagucuuagggcuacuguccccgcccgggguuccuccagcaugucuucuaacucuucuauugcuacuucuguguauucaaaucaaaccaccucgacgagacuugguucuacagcugguucugguaccagugucucgagccucccgucaacugcaaggacuaggagcuggguugaggaucaaaauaggaauuugucaccuuucaugaggggggcccacaacaucucguuugucaccccaccaucuagcauauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8794 - RNA, 807 nt, Artificial Sequence
  capsid_protein_VP2__Norovirus__AHX22039
auggcuggagcuuucuuugcuggauuggcaucugauguccuuggcucuggacuugguucccuuaucaaugcuggggcuggggccaucaaccaaaaaguugaguuugaaaauaacagaaaauugcaacaagcaucauuccaauuuagcagcaaucugcaacaggcuuccuuucaacaugacaaagagaugcuccaagcacaaauugaggccaccaaaaagcuacaacaggaaaugaugaaaguuaagcaggcaaugcuccuagaggguggguucucugagacagaugcagcccgcggggcaauuaacgcccccaugacaaaagcuuuggacuggagcgggacaagguacugggcucccgaugcuaggacuacaacauacaaugcaggccgcuuuuccaccccucaaccaucgggggcacugccaggaagagcuaaucuuagggaugcugucccugcucgggguuccuccagcaaauccucuaacucuucuacugcuacuucuguguauucaaaucaaacuacuucaacgagacuugguucuacagcugguucugguaccagugucucgagccucccgucaacugcaaggacuaggagcuggguugaggaucaaaguaggaauuugucaccuuucaugaggggggcccacaacauaucguuugucaccccaccaucuagcagauccucuagccaaggcacagucucaaccgugccuaaagagguuuuggacuccuggacuggcgcuuucaacacgcgcaggcagccucucuucgcucacauucguaaacgaggggagucacggguguaa

SEQ ID NO: 8795 - RNA, 807 nt, Artificial Sequence
  capsid_protein_VP2__Norovirus__AHX22042
auggcuggagcuuucuuugcuggauuggcaucugauguccuuggcucuggacuugguucccuuaucaaugcuggggcuggggccaucaaccaaaaaguugaguuugaaaauaacagaaaauugcaacaagcauccuuccaauuuagcagcaaucuacaacaggcuuccuuucaacaugacaaagagaugcuccaagcacaaauugaggccaccaaaaagcuacaacaggaaaugaugaaaguuaagcaggcaaugcuccuagaggguggguucucugagacagaugcagcccgcggggcaaucaacgcccccaugacaaaagcuuuggacuggagcgggacaagauacugggcucccgaugcuaggacuacaacauacaaugcaggccgcuuuuccaccccucaaccaucggggguacugccaggaagagcuaaucuuagggaugcugucccugcucgggguuccuccagcaaaucuucuaacucuuuuacugcuacuucuguguacucaaaucaaacuacuucaacgagacuugguucuacagcuggcucugguaccagugucucgagccucccgucaacugcaaggacuaggagcuggguugaggaucaaagcaggaauuugucaccuuucaugaggggggcccacaacauaucguuugucaccccaccaucuagcagauccuccagccaaggcacagucucaaccgugccuaaagagguuuuggacuccuggacuggcgcuuucaacacgcgcaggcagccacucuucgcucacauucguaagcgaggggagucacggguguaa

SEQ ID NO: 8796 - RNA, 807 nt, Artificial Sequence
  capsid_protein_VP2__Norovirus__AHX22048
auggcuggagcuuucuuugcuggauuggcaucugacguccuuggcucuggacuuaguucccuaaucaaugcuggggcuggggccaucaaccaaaaaguugaauuugaaaauaacagaaaauugcaacaagcuuccuuccaauuuaguagcaaucuacaacaggcuuccuuucaacaugacaaagagaugcuccaagcacaaauugaggccaccaaaaaguugcaacaggaaaugaugagaguuaaacaagcaaugcuccuagaggguggauucucugagacagaugcagcccguggggcaauuaacgcccccaugacaaaagcuuuggacuggagcgggacaagguacugggcucccgaugcuaggacuacaacauauaaugcaggccgcuuuuccaccccccaacccucgggggcacuaccaggaagagcuaaucuuagggcugcuguccccgcccgggguuccuccagcaugucuucuaacucuucuacugcuacuucuguguauucaaaucaaaccaccucaacgagacuugguucuacagcugguucugguaccagugucucgagccucccgucaacugcaaggauuaggagcuggguugaggaucaaaauaggaauuugucaccuuucaugaggggggcccacaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacgggcguaa

SEQ ID NO: 8797 - RNA, 807 nt, Artificial Sequence; identical to SEQ ID NO: 8793
  capsid_protein_VP2__Norovirus__AHX22051

SEQ ID NO: 8798 - RNA, 807 nt, Artificial Sequence
  capsid_protein_VP2__Norovirus__AHX22055
auggcuggagccuucuuugcuggauuggcaucugacguccuuggcucuggacuuaguucccuaaucaaugcuggggcuggggccaucaaccaaaaaguugaauaugaaaacaacagaaaauugcaacaagcuucuuuccaauuuaguagcaaucuacaacaggcuuccuuucaacaugacaaagagaugcuccaagcacaaauugaggccaccaaaaaguugcaacaggaaaugaugagaguuaaacaagcaaugcuccuagaggguggguucucugagacagaugcagcccguggggcaaucaacgcccccaugacaaaaacuuuggacuggagcggaacaagguacugggcucccgaugcuaggacuacaacauacaaugcaggccgcuuuuccaccccucaacccucgggggcacuaccaggaagagcuaaucucagggcuacuguccccgcccgggguuccucuagcacgucuucuaacucuucuauugcuacuucuguguauucaaaucaaaccaccuuaacgagacuugguucuacagcugguucugguaccagugucucgagccucccgucaacugcaaggacuaggagcuggguugaggaucaaaauaggaauuugucaccuuucaugaggggggcccacaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacggguguaa

SEQ ID NO: 8799 - RNA, 693 nt, Artificial Sequence
  capsid_protein_VP2__Norovirus__AII02849
auggcuggagcuuuuauagcaggauuggcuggugacaugcucacaaauacuguaggaucuuuaguuaaugcaggggcuaaugccauuaaucaaacaauugauuuugaaaauaauaaauauuugcaaaaugccucuuuuaaucaugauaaggagauguugaaugcacaaauugaggcaacaaagagguuacaggcugacaugauugcuaucaaacaagggguguugaccgcuggcggcuucucccccacugaugcagcccgcggggcaauuaaugcccccaugacaaaaguccuagauuggaauggaacgagauacugggcgccaggcgccaccuccacaaccucgaugucggguggcuucauaaaucaaacugugcacagauccacaccaaauuuuaaaacgaaccaggcccccaaacccgcacccagcagugggucuucagugaggucaaauucaacccaaaucacuagccugagcucacacucguccgggucgucucgauccagcgggucuacaguugucagcucaauaccguccucuaacaggacuagggacuggguuaaccaacaaaauuuuaauuuggaaccacacaugccuggaucucuuaggacagcuuuugucacuccaccaucuaguacagccucuagcucaggcacagucucaacugugcccaaaaauguuuuggacuccuag

SEQ ID NO: 8800 - RNA, 804 nt, Artificial Sequence
  capsid_protein_VP2__Norovirus__AKE07101
auggcuggagcuuucuuugcuggauuggcaucugacguccuuggcucuggacuugguucccugaucaaugcuggggcuggggccaucaaccaaaaaguugaauuugaaaauaacagaaaauugcaacaagcuuccuuucaauuuagcagcaauuuacaacaggcuuccuuucaacaugauaaggagaugcuccaagcacaaauugaggccaccaaaaaguugcaacaggaaaugaugaaaguuaaacaggcagugcuccuagaggguggauucucugagacagacgcagcccguggggcaaucaacgcccccaugacaaaggcuuuggacuggagcgggacaagguacugggcucccgaugcuaggacuacaacauacaaugcaggccacuuuuccaccccucaacccucgggggcaccgcuagggagggcuaaucuuagggcugcuguccccacucgggguuccuccagcacaucuucuaacucuucuauugcuacuucuguguauucaaaucaaacugcuucaacgagacuugguucuacagcugguucuggugccagugucucgagccucccgucaacugcaaggacuaggagcuggguugaggaucaaaggaacuugucaccuuucaugaggggggcccacaacauaucguuugucaccccaccaucuagcagauccucuagccaaggcacagucucaaccgugccuaaagaaguuuuggacuccuggacuggcgcuuucaacacgcgcaggcagccucucuucgcucacauucguaagcgaggggagucacggguguaa

SEQ ID NO: 8801 - RNA, 807 nt, Artificial Sequence
  capsid_protein_VP2__Norovirus__AKE07104
auggcuggagccuucuuugcuggauuggcaucugacguccuuggcucugggcuugguucucugaucaaugcuggggcuggggccaucaaccaaaaaguugaauuugaaaauaacagaaaauugcaacaagcuuccuuccaauuuagcagcaaucuacaacaagcuucuuuucaacaugauaaagagaugcuccaagcacaaauugaggccaccaaaaaguugcagcaggaaaugaugaaaguuaaacaggcagugcuccuagaggguggguucucugagacagaugcagcccguggggcgaucaacgcccccaugacaaaggcuuuggacuggagcgggacaagguacugggcuccugaugcuaggacuacaacauacaaugcaggccgcuuuuccaccccucaaccaucggggauacugccgggaagagcuaaucuuagggauacuguccccgcucgggguuccuccagcacaucuucuaaaucuucuauugcuacuucuuuguauucaaaucaaacugcuacaacgagacuugguucuacagcugguucugguaccagugucucgagccucccgucaacugcaaggacuaggagcuggguugaggaucaaaauaggaauuugucaccuuucaugaggggggcccacaacauaucguuugucaccccaccaucuagcagauccucuagccaaggcacagucucaaccgugccuaaagaaguuuuggacuccuggacuggcgcuuucaacacgcgcaggcagccucucuucgcucacauucguaagcgaggggagucacggguguaa

SEQ ID NO: 8802 - RNA, 807 nt, Artificial Sequence
  capsid_protein_VP2__Norovirus__AKE07107
auggcuggagcuuucuuugcuggauuggcaucugacguccuuggcucuggacuugguucccugaucaaugcuggggcuggggccaucaaccaaaaaguugaauuugaaaauaacagaaaauugcaacaagcuuccuuccaauuuagcagcaaucuacaacaggcuuccuuucaacaugauaaagauaugcuccaagcacaaauugaggccaccaaaaaguugcaacaggaaaugaugagaguuaaacaggcaaugcuccuagaggguggauucucugagacagaugcagcccguggggcaaucaacgcccccaugacaaaggcuuuggacuggagcgggacaagguacugggcucccgaugcuaggacuacaacauacaaugcaggccacuuuuccaccccucaacccucgggggcgcugccagggagagcuaaucucagggcugcuguccccgcucggggucccuccagcacaucuucuaauucuucuacugcuacuucuguguacucaaaucaaaccacuucaacgagacuugguucuacagcugguucuggugccagugucucgagccucccgucaacugcaaggaccgugaacuggguuagggaucaaaacaggaguuugucaccuuucaugaggggggcccacaacacaucguuugucaccccaccgucuagcagauccucuagucaaggcacagucucaaccgugcccaaagaaguuuuggacuccuggacuggcgcuuucaacacgcgcaggcagccucucuucgcucacauucgcacgcgaggggagucacggguguaa

SEQ ID NO: 8803 - RNA, 765 nt, Artificial Sequence
  capsid_protein_VP2__Norovirus__ALE30634
auggcuggagccuuuauagcaggauuggcuggugacaugcucacaaacacuguagggucuuuaguuaaugcaggggcuggugcuauuaaucaaaaaguugauuuugaaaauaauaaauaucuacaaaaugcauccuuuaaucaugauaaggagauguuaaaugcacaaauugaggcaacuaagaggcuacaggcugacaugauugcuaucaaacaagggguuuugaccgcuggcgguuucucccccacugaugcagcccguggggcuauuaacgcccccauaacaaaaguucuggacuggaguggaaccagguacugggcaccaaaugccaccuccacaacuucaaugucagguggcuucacaggucaagcugugcauagagcuacaccaaauuuuaaaaccaaccaagccccaaaauccacacccagcagugggucuucagugaggucaagcucaacccaacucaccaacuugagcucacacucaucugggucuucucgauccagcggauccacgauggucagcucguuaccaucuuccagcaggacuagagacuggguuaaccaacagaauuuuaauuuggaaccacacaugccuggaucucuuaggacagcuuuuguuacuccaccaucuaguacagccucuagcuuagacacggucucaaccgugcccaagaguguuuuggacuccuggacaccugcguuuaacacgcgcagacagccgcucuucgcacaccuucguagaaggggggagucaaauauuuag

SEQ ID NO: 8804 - RNA, 765 nt, Artificial Sequence
  capsid_protein_VP2__Norovirus__ALE30636
auggcuggagccuuuauagcaggauuggcuggugacaugcucacaaauacuguagggucuuuaguuaaugcaggggcuggugcuauuaaucaaaaaguugauuuugaaaauaauaaauaucuacaaaaugcauccuuuaaucaugauaaggagauguuaaaugcacaaauugaggcaacaaagaggcuacaggcugacaugauugcuaucaaacaagggguuuugaccgcuggcgguuucucccccacugaugcagcccguggggcuauuaacgcccccauaacaaaaguucuggacuggaguggaaccagguacugggcaccaaaugccaccuccacaacuucaaugucagguggcuuuacaggucaagcuguacacagagcuacaccaaauuuuaaaaccaaucaagccccaaaauccacacccagcagugggucuucagugaggucaagcucaacccaacucaccaacuugagcucacacucaucugggucuucucgauccagcggauccacgauggucagcucguuaccaucuuccaguaggacuagagacuggguuaaccaacagaauuucaauuuggaaccacacaugccuggaucucucaggacagcuuuuguuacuccaccaucuaguacagccucuagcuuagacacggucucaaccgugcccaagaguguuuuggacuccuggacaucugcguuuaacacgcacagacagccgcuuuucgcacaccuucguaaaaggggggagucaaauguuuag

SEQ ID NO: 8805 - RNA, 780 nt, Artificial Sequence
  capsid_protein_VP2__Norovirus__BAR42290
auggcuggggcuuucauugcaggauuggcaggcgacaugcucacgucaucugugggcucccuugugaacgcaggggcaaacgccaucaaccaaaagauagacuuugaaaacaacaaacaacuccagucugcuuccuuucagcaugauaaagagaugcuccaagcgcaggugagggcaaccaagcagcugcaaucugaaaugauagcccuaaaacaggggguuuuggccgcaggcggcuuuucccccacugaugcagcaaggggauccauuggugcacccaugacaaaggugcuugacuggucuggcacucgauacugggcgcccaauuccacaaagacaacuggcuauucgggacaauucaccucuucaccugugcauaugucuagcccaaaugcuccacaaucaaaaccugcaaagccuaggucucuagcuccuuccucuucuucuagcagugucuauaguauguauacucaaucuacucauuuaacaucuggcucuucuaguaaugcuucuucugccuccacaaaauugacaaguuuaagcucuggcuccucucaaaacagaacggcagaguggguaaaucaacagagaagucuuagcccuuucaugaguggcgcacuuaacaucucacaugucacgccacccucaaguagggcuuccaguucugggacggucucgaccgugcccaaggaaguuuuggacuccuggacgucugcguuuaacacacacagacagccgcucuucgcacaccucagagugaggggggagucacguguuuag

SEQ ID NO: 8806 - RNA, 780 nt, Artificial Sequence
  capsid_protein_VP2__Norovirus__BAR47617
auggcuggagcuuucauugcaggauuggcaggcgacaugcucacgucaucugugggcucccuggugaacgcaggggcaaacgccaucaaccaaaagauagacuuugaaaacaacaaacaacuccagucugcuuccuuucagcaugauaaagagaugcuccaagcgcaggugaaggcaaccaagcagcugcaaucugaaaugauagcccuaaaacaggggguuuuggccgcaggcggcuuuucccccacugaugcagcaaggggagccauuggugcacccaugacaaaggugcuugacuggucuggcacucgauacugggcacccaauuccacaaagacaacugguuauucgggacaauucaccucuucaccugugcacaugccuagcccaaaugcuccacaaucaaaaccugcaaagccuaggucucuagcuccuucuucuucuucuaguagugucuauaguaugucuacucaaucaacucauuuaacaucuggcucuucuaguaaugcuucuucugccucuacaaaacugacaaauuuaagcucuggcuccucucaaaacagaacagcagagugggugaaccaacagagaagucuuagcccuuucaugaguggcgcacucaauaucucacaugucacgccacccucaaguagggcuuccaguucugggacggucucgaccgugcccaaggaaguuuuggacuccuggacgucugcguuuaacacacacagacagccgcucuucgcacaccucagagugaggggggagucacguguuuag

SEQ ID NO: 8807 - RNA, 780 nt, Artificial Sequence
  capsid_protein_VP2__Norovirus__BAR63716
auggcuggagcuuucauugcaggauuggcaggcgacaugcucacgucaucugugggcucccuggugaacgcaggggcaaacgccaucaaccaaaagauagacuuugaaaacaacaaacaacuccagucugcuuccuuucagcaugauaaagagaugcuccaagcgcaggugaaggcaaccaagcagcugcaaucugaaaugauagcccuaaaacaggggguuuuggccgcaggcggcuuuucccccacugaugcagcaaggggagccauuggugcacccaugacaaaggugcuugacuggucuggcacucgauacugggcacccaauuccacaaagacaacugguuauucgggacaauucaccucuucaccugugcgcaugccuagcccaaaugcuccacaaucaaaaccugcaaagccuaggucucuagcuccuuccucuucuucuaguagugucuauaguaugucuacucaaucaacucauuuaacaucuggcucuucuaguaaugcuucuucugccucuacaaaauugacaaacuuaagcucuggcuccucucaaaacagaacagcagagugggugaaccaacagagaagucuuagcccuuuuaugaguggcgcacucaauaucucacaugucacgccacccucaaguagggcuuccaguucugggacggucucgaccgugcccaaggaaguuuuggacuccuggacgucugcguuuaacacacacagacagccgcucuucgcacaccucagagugaggggggagucacguguuuag

SEQ ID NO: 8808 - RNA, 780 nt, Artificial Sequence
  capsid_protein_VP2__Norovirus__BAR63719
auggcuggagcuuucauugcaggauuggcaggcgacaugcucacgucaucugugggcucccuggugaacgcaggggcaaacgccaucaaccaaaagauagacuuugaaaacaacaaacaacuccagucugcuuccuuucagcaugauaaagagaugcuccaagcgcaggugaaggcaaccaagcagcugcaaucugaaaugauagcccuaaaacaggggguuuuggccgcaggcggcuuuucccccacugaugcagcaaggggagccauuggugcacccaugacaaaggugcuugacuggucuggcacucgauacugggcacccaauuccacaaagacaacugguuauucgggacaauucaccucuucaccugugcacaugccuagcccaaaugcuccacaaucaaaaccugcaaagccuaggucucuagcuccuucuucuucuucuaguagugucuauaguaugucuacucaaucaacucauuuaacaucuggcucuucuaguaaugcuucuucugccucuacaaaauugacaaacuuaagcucuggcuccucucaaaacagaacagcagagugggugaaccaacagagaagucuuagcccuuucaugaguggcgcacucaauaucucacaugucacgccacccucaaguagggcuuccaguucugggacggucucgaccgugcccaaggaaguuuuggacuccuggacgucugcguuuaacacacacagacagccgcucuucgcacaccucagagugaggggggagucacguguuuag

SEQ ID NO: 8809 - RNA, 780 nt, Artificial Sequence; identical to SEQ ID NO: 8806
  capsid_protein_VP2__Norovirus__BAR63722

SEQ ID NO: 8810 - RNA, 807 nt, Artificial Sequence
  capsid_protein_VP2__Norovirus__BAS02084
auggcuggagcuuucuuugcuggauuggcaucugauguccuuggcucuggacuugguucccuuaucaaugcuggggcuggggccaucaaccaaaaaguugaguuugaaaacaacagaaaauugcaacaagcauccuuccaauuuagcagcaaucuacaacaggcuuccuuucaacaugacaaagagaugcuccaagcacaaauugaggccaccaaaagguuacaacaggaaaugaugaaaguuaagcaggcaaugcuccuagaggguggguucucugagacagaugcagcccgcggggcaaucaacgcccccaugacaaaagcuuuggacuggaacgggacaagguacugggcuccugaugcuaggacuacaacauacaaugcaggccgcuuuuccaccccucaaccaucgggggcgcugccaggaagagcuaaucuuagggaugcugucccugcucgggguuccucuaguaagucuucuaauucuucuacugcuacuucuguguacucaaaucaaacuauuucaacgagacuugguucuacagcugguucugguaccagugucucgagcuucccgucaacugcaaggacuaggagcuggguugaggaucaaaguaggaauuugucaccuuucaugaggggggcccacaacauaucguuugucaccccaccaucuagcagauccucuagccaaggcacagucucaaccgugccuagagagauuuuggacuccuggacuggcgcuuucaacacgcgcaggcagccacucuucgcucacauucguaagcgaggggagucacggguguaa

SEQ ID NO: 8811 - RNA, 627 nt, Artificial Sequence
  capsid_protein_VP2__Norovirus__CRL46953
auggcccaagccauuauaggagccauugcugccuccgcggcuggcagugcccugggugcuggcauucaggcuggugcugaagcugcauuacaggcacagagauaucaacaagauuuaacuuuacagcagaauucuuucaaucaugauaaagaaauguuagguuaucagguagaaauguccaauaagcuauuagcuaaaaaucuuaauacccgcuauucucuucuccaggcggguggucucucccccucugaugcggcuagggcuguggccggggccccugucacuagguugguugacugggguggaguucguguugcagcaccccaaucaucugccaccacacugagaucuggcaauuuuauggcagugccacucccagcccagccaaagcagaaaccucuugcuagugagggauauuccaauccagcuuaugacccuaugcagcgcacagcuucuuggguucaaucccaaaauuccagccggaauugguccccauaccauaggcaagcccuccaaacugugugggugacccccccugguucuacuucuucuucuucuguuucuacugccccucgaggguauuuuaauacagauagauugccucuguucgcaaacuugaggcgcuaa

SEQ ID NO: 8812 - RNA, 630 nt, Artificial Sequence
  capsid_protein_VP2__Norovirus__CRL46956
auggcucaagcugucaucggugccauagccgcgucugccgcugguagcauacuaggggcaggcauacaggcuggugcugaggcuggucuucaggcucaacgguaccagcaggaucuacaguugcagcaaaauucuuuuaagcaugauaaggaaauguuaggcuaucaaguucaggcuaguaaugcucuuuuggcuaagaaucuuaacacuagauaugcucuucugcaggcagggggccugucuagugcugaugcugcucgggcaguggcuggugcuccugucacucguauaguggauuggaauggcacgcgcauugcagcgcccgccucaagugccaccacacucagaucuggugguuuuauggccgucccuauaccauugucuucaaagaccaagcaaccagugaugucugggcaggacaauccaaauuaugcugcuucuucuaucucuagaacugcuucaugggugcaaucucaaaauucuaugaggucugucucucccuuucacagugaugcucugagaaccguuugggucacaccacccgguucaucaucaacuucaucugugcagucuaguuuuuaugguguuuuuaauacagauagauugccucuguucgcaaacagaagguaa

SEQ ID NO: 8813 - RNA, 807 nt, Artificial Sequence
  capsid_protein_VP2__Norovirus__CRL46959
auggcuggagcuuucuuugcuggauuggcaucugacguccuuggcucuggacuuaguucccuaaucaaugcuggggcuggggcuaucaaccaaaagauugauuuugaaaauaacagaaaauugcagcaagcuuccuuccaguuuagcagcaaccuacaacaggcuuccuuucaacaugauaaagagaugcuccaagcacaaguugaggcuacuaaaaaguugcaacaggaaaugaugaaagucaaacaagcaauacucuuagaagguggauucucugcaacagaugcagcccguggggcaaucaaugcccccaugacaaagguuuuggacuggaauggaacaagguauugggccccugaugcuaggaccacaacauacaauacaggccacuuuuccaccccucaauccucgggggcacugccaggaagaacuaaucccagaauucccacccccgcucgggcuuccucuaguacaucuucuaaugcuucuacugcuacuucuauaaguucaaaucaaacuguuucaacgagacuugguucuacagcugguucuggcaccaaugucucgagucucccgucaacugcaaggaccaggaguuggguugaggaucaaaauagaaauuugucaccuuucaugaggggagcucacaacauaucguuugucaccccaccaucuagcagauccucuagucaaggcacagucucaaccgugccuaaaggaguuuuggacuccuggacuggcgcuuucaacacgcgcaggcagccucucuucgcuuacacucauaggcgaggggagucacggguguaa

SEQ ID NO: 8814 - RNA, 807 nt, Artificial Sequence
  capsid_protein_VP2__Norovirus__CRL46962
auggcuggagcuuucuuugcuggauuggcaucugauguccuuggcucuggacuugguucucuuaucaaugcuggggcuggggccaucaaccaaaaaguugaauuugaaaauaacagaaaauugcaacaagcauccuuccaauuuagcagcaaucugcaacaggcuuccuuucaacaugacaaagagaugcuccaagcacaaauugaggccaccaaaaagcuacaacaggaaaugaugaaaguuaaacaggcaaugcuccuagaggguggguucucugagacagaugcagcccgcggggcaaucaacgcccccaugacaaaagcuuuggacuggagcgggacaagguauugggcucccgaugcuaggacuacaacauacaaugcaggccgcuuuuccaccccucaaccaucgggggcauugccaggaagagcuaaucuuagggaugcugucccugcucggggucccuccagcaaauuuucuaacucuucuacugcuacuucuguguacucaaaucaaacuauuucaacgaggcuugguucuacagcugguucuggaaccagugucucgagccucccgucaacugcaaggacuaggagcuggguugaggaucaaaguaggaauuugucaccuuucauggggggggcccacaacauaucguuugucaccccaccaucuagcagauccucuagccaaggcacagucucaaccgugccuaaagagauuuuggacuccuggacuggcgcuuucaacacgcgcaggcagccucucuucgcucacauucguaagcgaggggagucacggguguaa

SEQ ID NO: 8815 - RNA, 807 nt, Artificial Sequence
  capsid_protein_VP2__Norovirus__CRL46965
auggcuggagcuuucuuugcuggauuggcaucugauguccuuggcucuggacuugguucccuuaucaaugcuggggcuggggccaucaaccaaaaaguugaguuugaaaauaacagaaaauugcaacaagcauccuuccaauuuagcagcaaucuacaacaggcuuccuuucaacaugauaaagaaaugcuccaagcacagauugaggccaccaaaaagcuacaacaggaaaugaugaaaguuaagcaggcagugcuccuagaggguggauuuucugagacagaugcagcccgcggggcaaucaacgcccccaugacaaaagcuuuggacuggagcgggacaagguacugggcucccgaugcuaggacuacaacauacaaugcaggccgcuuuuccaccccucaaccaucgggggcacugccaggaagagcuaaucuuagggaugcugccccugcucgggguuccuccaguaaaucuucuaacucuuuuacugcuacuucuguguacucaaaucaaaccacuucaacgagacuugguucuacagcugguucugguaccagugucucgagccucccaucaacugcaaggacuaggagcuggguugaggaucaaagcaggaauuugucaccuuucaugaggggggcccauaacauaucguuugucaccccaccaucuagcagauccucuagccaaggcacagucucaaccgugccuaaagaaguuuuggacuccuggacuggcgcuuucaacacgcgcaggcagccacucuucgcucacauucguaggcgaggggagucacggguguaa

SEQ ID NO: 8816 - RNA, 777 nt, Artificial Sequence
  capsid_protein_VP2__Norovirus__CRL46968
auggcaggagcauuuuuagcuggauugguaggugacgccauaacaaguggugucgggucccuaaucaaugcuggggccaaugcaauuaaccaaaagguagaguaugauuuuaauaaacagcuccaauuggcauccuucaaacaugacaaggagauguugcagucacaaguacuggccacuaaacagcuccagcaggaaaugaugaacauaaggcaaggggucuuguccgcuggcggcuuuuccccuacagaugccgcgagaggugcugugaacgcgccgaugacaaaaauuuuggauuggaauggaacaagguacuucgccccaaauaguaugaagacaaccaguuauucgggccaguuuuccagcaacccuguacauaggcaacccacuucaccccguucugaccccccaaaaaucaagguuaauagugauucugcuaguguguauaguucugcaucuucugcuccuucacaaucaacccacucaacggcuuugacugcggggucuagcucaucuaggacaacauccucuucugcagcugcuuccacucuaucuagaaccagugacugggugagaggacaaaaugagaggcuuagcccguuuauggauggugcucuccaaacaacuuuugucacaccaccaucgagcaaggcuucaucauaugggucggucucaaccguucccaaagcuguuuuggacuccuggacuccuauguuuaauacccauaggcagccucucuucgcucaugugcgcaggcgaggggagucacagauuuag

SEQ ID NO: 8817 - RNA, 765 nt, Artificial Sequence
  capsid_protein_VP2__Norovirus__CRL46971
auggcuggggcuuuuauagcaggauuggcuggugacaugcucacaaauacuguaggaucuuuaguuaaugcaggagcuaaugcuauuaaucaaacaauugauuuagaaaauaauaaauauuugcaaaaugcuucuuuuaaucaugauaaggagauguugaaugcacaaauugaggcaacaaagaaguuacaggcugacaugauugcuaucaagcaaggggucuugaccgcuggcggcuucuccccuacugaugcagcccguggggcaauuaaugcccccaugacaaaaguccuagauuggaauggaacgagacacugggcaccaggugccaccuccacaaccucgaugucggguggcuuuacacaucaaacugugcacagauccacaccaaauuuuaaaacgaaccaggcucccaaauccacacccagcagugggucuucagugaggucaaacucaacccaaaucacuagccugaguucacacucguccgggucgucucgauccagcgggucuacaguuaucagaucaauaccauccucugacaggacuagggacugggucaaccaacaaaauuuuaauuuggaaccacauaugccuggaucucuuaggacagcuuuugucacuccaccaucuaguacagccucuagcucaggcacagucucaacugugcccaaaaauguuuuggacuccuggacaucugcguucaacacgcgcagacagccgcuauucgcacaccuucgcagaaggggggagucaaauguuuag

SEQ ID NO: 8818 - RNA, 771 nt, Artificial Sequence
  capsid_protein_VP2__Norovirus__CRL46974
auggcuggagcuuuuguagcagggcuugccggugauauagucaccaacagcauugguucacuugugaacgcuggagccaaugcaauaaaccaaaaaguggauuuugaaaacaacaaacaacuacagcaggccucuuucaaccaugaucaggaaauguugcaagcucaaauucaggccacaaaacaacuacaagcugacaugauugcgcucagacaagggguguugaccgcaggcggcuucuccccuacugacgcagcgagaggggcgguuaaugcgcccaugacgcaagucuuggauuggagugggaccagguacugggcccccggagccacaaaaacaacugcuuucuccggcggguucacaagcucccccaauaccaggacuauugugccuaagaaaacaucagccacaccagccuccacaucugugucuagaccuaguucucuugcuucuacugcuucuacccgcucaacauuuguuagcgggacuucuagccuuucuucuucgacuaggagcucuuuuaauucccagcccaccuccucuucuucucggacuagcgaaugggugcguagucaaaacagggugcuggagcccuacaugaggggaucguuacaaacugcuuucgugacgccucccucuaguagagccuccagcaauggcacagucucaaccgugccaaaagaaguuuuggacuccuggacaucuguguucaacacccacagacaaccgcuuuucgcucaucuccgucggagaggggagucacagguuuag

SEQ ID NO: 8819 - RNA, 807 nt, Artificial Sequence
  capsid_protein_VP2__Norovirus__CRL46977
auggcuggagcuuucuuugcuggauuggcaucugacguccuuggcucuggacuugguucccuaaucaaugcuggggcuggggccaucaaccaaaaaguugaauuugaaaauaauagaaaauugcaacaagcuuccuuccaauuuaguagcagucuacaacaagcuuccuuucaacaugacaaagaaaugcuccaagcacaaauugaggccaccaaaaaguugcaacaggaaaugaugagaguuaaacaagcaaugcuccuagaggguggauucucugagacagaugcagcccguggggcaaucaacgcccccaugacaaaaacuuuggacuggagcgggacaagguacugggcucccgaugcuaggacuacaacauauaaugcaggccgcuuuuccaccccucaacccucgggggcacuaccaggaagagcuaaucuuagggcuacugcccccgcccgggguuccuccagcaugucuucuaacucuucuauugcuacuucuguguauucaaaucaaaccacuucaacgagacuugguucuacagcugguucugguaccagugucucgagccucccgucaacugcaaggacuaggagcuggguugaggaucaaaauaggaauuugucaccuuucaugaggggggcccacaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacgggcguaa

SEQ ID NO: 8820 - RNA, 807 nt, Artificial Sequence
  capsid_protein_VP2__Norovirus__CRL46980
auggcuggagcuuuccuugcuggauuggcaucugacguccuuggcucuggacuugguucccuaaucaaugcuggggcuggggccaucaaccaaaaaguugaauuugaaaauaauagaaaauugcaacaagcuuccuuccaauuuaguagcagucuacaacaagcuuccuuucaacaugacaaagaaaugcuccaagcacaaauugaggccaccaaaaaguugcaacaggaaaugaugagaguuaaacaagcaaugcuccuagaggguggauucucugagacagaugcagcccguggggcaaucaacgcccccaugacaaaaacuuuggacuggagcgggacaagguacugggcucccgaugcuaggacuacaacauauaaugcaggccgcuuuuccaccccucaacccucgggggcacuaccaggaagagcuaaucuuagggcuacugcccccgcccgggguuccuccagcaugucuucuaacucuucuauugcuacuucuguguauucaaaucaaaccacuucaacgagacuugguucuacagcugguucugguaccagugucucgagccucccgucaacugcaaggacuaggagcuggguugaggaucaaaauaggaauuugucaccuuucaugaggggggcccacaacaucucguuugucaccccaccaucuagcagauccucuagccaaggcacagucucaaccgugcccaaagaaguuuuggacuccuggacuggcgcuuucaacacgcgcaggcagccucucuucgcucacauucgcaagcgaggggagucacgggcguaa

SEQ ID NO: 8821 - RNA, 1623 nt, Artificial Sequence
  derived and/or modified sequence opt1 from capsid_protein_VP1__Norovirus__ABY65350
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguccagcacggacaccgagaacgacuucgagacccaccagaacaccaaguucacgcccgucggcgugauccaggacggguccaccacccaccgcaacgagccccagcagugggugcuccccagcuacuccggccggaacguccacaacgugcaccuggccccggccguggcgcccaccuuccccggggagcagcuccucuucuuccgcagcacgguccccggcugcuccggcuacccgaacauggaccuggacugccugcucccccaggagugggugcagcacuucuaccaggaggccgcccccgcccagagcgacguggcgcugcugcgguucgucaaccccgacaccgggcgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgccggcgcgcccuguga

SEQ ID NO: 8822 - RNA, 1623 nt, Artificial Sequence
  derived and/or modified sequence opt1 from capsid_protein_VP1__Norovirus__ACO55068
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccggccgaggagauccccgcgccccugggcacccccgacuucguggggcgcauccagggcguccucacccagaccacgcgcggggacggcagcacccggggccacaaggccaccguguccaccggggacgugcacuucacgccgaagcugggcagcauccaguucaacaccgacaccaacaacgacuucgagaccgggcagaacacgaaguucacccccgucggcguggugcaggacgggaacggcacccaccagaacgagccccagcaguggguccugcccuccuacagcggccggaccgggcacaacgugcaccucgccccggccguggcccccacguuccccggcgagcagcugcuguucuuccgcagcaccaugcccgggugcuccggcuacccgaacaugaaccucgacugccugcugccccaggaguggguccagcacuucuaccaggaggcggcccccgcccagagcgacguggcccuccugcgguucgugaaccccgacaccgggcgcguccuguucgagugcaagcuccacaaguccggcuacgugaccguggcgcacaccggccagcacgaccuggucaucccgcccaacggguacuuccgguucgacagcugggugaaccaguucuacacgcuggcccccaugggcaacgggaccggccgccggcgcgcccucuga

SEQ ID NO: 8823 - RNA, 1623 nt, Artificial Sequence
  derived and/or modified sequence opt1 from capsid_protein_VP1__Norovirus__ADI45808
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccggaucaucgucgacgugcgccagcuggagcccgugcucaucccgcugcccgacguccggaacaacuucuaccacuacaaccagagcaacgaccccaccaucaagcugaucgccaugcucuacacgccccugcgcgccaacaacgcgggcgacgacguguucaccguguccugccggguccugacccgcccgagccccgacuucgacuucaucuuccucgugccgcccaccguggagucccggacgaagcccuucaccguccccauccugaccguggaggagaugaccaacagccgcuuccccaucccccuggagcggcucuacacgggcccguccagcgccuucgugguccagccccagaacgggcgcugcaccaccgacggcgugcugcuggggaccacgcagcucuccgccgucaacaucugcaccuuccggggcgacgugacccacaucgccggcagccgcaacuacaccaugaaccuggccucccagaacuggaacaacuacgaccccacggaggagaucccggcgccccuggggacccccgacuucgugggcaagauccaggggaugcucacccagaccacgcggagcgacggcuccacccgcgggcacaaggccaccguccugaccggcagcgccgacuucgcccccaagcugggccgggugcaguucgccacggacaccgacaacgacuucgagagcgggcagaacaccaaguucaccccggugggcgucauccaggacggguccacgacccaccgcaacgagccccagcagugggugcuccccaacuacagcggccggaccgggcacaacgugcaccuggcgcccgccgucgccccgaccuaccccggcgagcagcuccuguucuuccgcuccacgaugcccggcugcagcggguaccccaacauggaccuggacugccugaucccgcaggacugggugcagcacuucuaccaggaggccgcgcccgcccaguccgacguggcccuccugcgguucgucaaccccgacaccggccgcgugcuguucgagugcaagcuccacaagagcggguacgugaccgucgcccacaccggccagcacgaccuggugaucccgcccaacggguacuuccgcuucgacuccugggugaaccaguucuacacccuggcccccaugggcaacggcacggggcggcgccgggcgcucuga

SEQ ID NO: 8824 - RNA, 1623 nt, Artificial Sequence
  derived and/or modified sequence opt1 from capsid_protein_VP1__Norovirus__ADI45811
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccccugguccgcgccgcugggccccgaccugaaccccuaccucagccaccuggcccgcauguacaacggcuacgccgggggcuucgaggugcaggucauccuggccgggaacgccuucacggcgggcaagaucaucuucgccgccgugcccccgaacuuccccaccgaggggcucucccccagccaggugaccauguucccccacaucaucgucgacgugcggcagcuggagccggugcugaucccccuccccgacguccgcaacaacuucuaccacuacaaccaguccaacgaccccaccaucaagcugaucgccaugcuguacacgccgcuccgggccaacaacgcgggcgacgacguguucaccgugagcugccgcguccugacccggcccucccccgacuucgacuucaucuuccuggugcccccgaccguggagagccgcacgaagcccuucuccguccccauccucaccguggaggagaugaccaacagccgguuccccaucccgcuggagaagcuguucaccggccccuccagcgccuucgugguccagccccagaacgggcgcugcacgaccgacggcgugcuccuggggaccacccagcuguccccggucaacaucugcacguuccggggcgacgugacccacaucaccggcagccgcaacuacaccaugaaccucgccacgcagaacuggaacuccuacgaccccaccgaggagauccccgcgccccuggggaccccggacuucgugggcaagauccaggggguccugacccagacgacccgggccgacggcagcacccgcgggcacaaggccaccguguacacgggcagcgccgacuucgcccccaagcucggccgggugcaguucgccaccgacaccgacaacgacuucgacgccaaccagaacaccaaguucacgcccgucggggugauccaggacggcgacaccgcgcaccgcaacgagccccagcagugggugcugccguccuacagcgggcggaacucccacaacguccaccuggcccccgccguggcccccaccuuccccggcgagcagcuccuguucuuccgcagcaccaugccggggugcuccggcuaccccaacauggaccuggacugccuccugccccaggagugggugcaguacuucuaccaggaggcggcccccgcccagagcgacgucgcccugcuccgguucgugaacccggacacgggccgcgugcuguucgagugcaagcugcacaaguccggguacgucaccguggcccacaccggccagcacgaccucgugaucccgcccaacggguacuuccgguucgacagcugggucaaccaguucuacacccuggcgcccaugggcaacgggaccggccgccgccgggcccuguga

SEQ ID NO: 8825 - RNA, 1623 nt, Artificial Sequence
  derived and/or modified sequence opt1 from capsid_protein_VP1__Norovirus__ADI45812
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucaccccgaagcugggccgggugcaguucgccaccgacaccgacaacgacuucgacgccaaccagaacacgaaguucacccccgucggggugauccaggacggcaacaccgcccaccgcaacgagccccagcagugggugcugcccuccuacagcgggcggaacucccacaacguccaccucgcgccggccguggcccccaccuuccccggcgagcagcugcuguucuuccgcagcacgaugcccgggugcuccggcuacccgaacauggaccucgacugccugcugccccaggagugggugcaguacuucuaccaggaggccgcgcccgcccagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgggcgcucuga

SEQ ID NO: 8826 - RNA, 1623 nt, Artificial Sequence
  derived and/or modified sequence opt1 from capsid_protein_VP1__Norovirus__ADI45814
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcagccgcaacuacaccaugaaccuggccacccagaacuggaacuccuacgacccgacggaggagauccccgcgccccuggggacccccgacuucgugggcaagauccaggggguccucacccagaccacgcgggccgacggcagcacccgcgggcacaaggccaccguguacaccggcagcgccgacuucgccccgaagcugggccgggugcaguucgccacggacaccgacaacgacuucgacgcgaaccagaacaccaaguucacccccgucggggugauccaggacggcgacacggcccaccgcaacgagccccagcagugggugcugcccuccuacagcgggcggaacucccacaacguccaccucgccccggccguggcgcccaccuuccccggcgagcagcugcuguucuuccgcagcaccaugcccgggugcuccggcuacccgaacauggaccucgacugccugcugccccaggagugggugcaguacuucuaccaggaggccgcccccgcccagagcgacgucgcccuccugcgguucgugaaccccgacaccggccgcgugcuguucgagugcaagcuccacaaguccggguacgucacgguggcgcacaccggccagcacgaccuggugaucccgcccaacggguacuuccgguucgacagcugggucaaccaguucuacacccuggcccccaugggcaacgggaccggccgccgccgggcccucuga

SEQ ID NO: 8827 - RNA, 1623 nt, Artificial Sequence
  derived and/or modified sequence opt1 from capsid_protein_VP1__Norovirus__ADI45815
augaagauggccagcuccgacgccaaccccuucgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacgggcgcugcacgaccgacggcgugcuccuggggaccacccagcucagccccgucaacaucugcacguuccggggcgacgugacccacaucaccggcucccgcaacuacaccaugaaccuggccacgcagaacuggaacagcuacgacccgaccgaggagauccccgcgccccuggggacccccgacuucgugggcaagauccaggggguccucacccagacgacccgggccgacggcuccacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcaacaccgcgcaccgcaacgagccccagcagugggugcugcccagcuacuccgggcggaacagccacaacguccaccucgccccggccguggcccccaccuuccccggcgagcagcugcuguucuuccgcuccaccaugcccgggugcagcggcuacccgaacauggaccucgacugccugcugccccaggagugggugcaguacuucuaccaggaggcggcccccgcccaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcgcccaugggcaacgggaccggccgccgccgggcccucuga

SEQ ID NO: 8828 - RNA, 1623 nt, Artificial Sequence
  derived and/or modified sequence opt1 from capsid_protein_VP1__Norovirus__ADI45816
augaagauggccagcaacgacgccaaccccuccgacggcagcgcggccaaccuggugccggagaucaacaacgaggucauggcccucgagcccguggugggggccgccaucgcggcccccgucgccggccagcagaacgugaucgaccccuggauccgcaacaacuucgugcaggcccccgggggcgaguucaccgucagcccccggaacgcgcccggggagauccugugguccgcgccccugggcccggaccucaaccccuaccugucccaccuggcccgcauguacaacggcuacgccgggggcuucgagguccaggugauccccgccgggaacgccuucaccgccggcaagaucaucuucgccgccgugcccccgaacuuccccacggaggggcucagccccucccaggugaccauguucccccacaucaucguggacguccggcagcuggagccggugcugaucccccuccccgacgugcgcaacaacuucuaccacuacaaccagagcaacgacuccaccaucaagcugaucgccaugcuguacacgccccuccgggcgaacaacgccggcgacgacgucuucaccgugagcugccgcgugcugacccggccgucccccgacuucgacuucaucuuccuggucccgcccaccguggagagccgcaccaagccguucacggugcccauccucaccgucgaggagaugaccaacucccgguuccccaucccccuggagaagcuguucaccggcccgagcuccgccuucguggugcagccccagaacgggcgcugcacgaccgacggcguccuccuggggaccacccagcugagccccgugaacaucugcacguuccggggcgacgucacccacaucgccggcucccgcaacuacaccaugaaccucgccagccugaacuggaacaacuacgacccgaccgaggagauccccgcgccccuggggacgcccgacuucgugggcaagauccagggggugcucacccagaccaccaaggaggacggcuccacgcgggggcacaaggccaccgucuacaccggcagcgccgacuucaccccgaagcugggcagcgugcaguucgggacggacaccgagaacgacuucgagacccaccagaacaccaaguucacgcccgugggcgucauccaggacggguccaccacccaccgcaacgagccccagcagugggugcugcccagcuacuccggccggaacgugcacaacguccaccucgccccggccguggcgcccaacuuccccggggagcagcugcuguucuuccgcagcaccaugcccggcugcuccggcuacccgaacauggaccucgacugccugcugccccaggagugggugcagcacuucuaccaggaggccgcccccgcccagagcgacgucgcgcuccugcgguucgugaaccccgacacggggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcaccggccgccggcgcgcccucuga

SEQ ID NO: 8829 - RNA, 1623 nt, Artificial Sequence
  derived and/or modified sequence opt1 from capsid_protein_VP1__Norovirus__ADI45817
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccccgugcccccgaccguggagucccgcacgaagcccuucaccguccccauccucaccguggaggagaugaccaacagccgguuccccaucccgcuggagcgccuguacacgggccccuccagcgccuucgugguccagccccagaacgggcggugcaccaccgacggcgugcuccuggggaccacgcagcuguccgccgucaacaucugcaccuuccgcggcgacgugacccacaucgccggcagccggaacuacaccaugaaccucgccucccagaacuggaacaacuacgacccgacggaggagauccccgcgccccuggggacccccgacuucgugggcaagauccaggggaugcugacccagaccacgcgcagcgacggcuccacccgggggcacaaggccaccguccucaccggcagcgccgacuucgccccgaagcugggccgcgugcaguucgccacggacaccgacaacgacuucgagagcgggcagaacaccaaguucacccccgugggcgucauccaggacggguccacgacccaccggaacgagccccagcagugggugcugcccaacuacagcggccgcaccgggcacaacgugcaccucgcgccggccgucgcccccaccuaccccggcgagcagcugcuguucuuccgguccacgaugcccggcugcagcggguacccgaacauggaccucgacugccugcugccccaggagugggugcagcacuucuaccaggaggccgcgcccgcccaguccgacguggcccuccugcgcuucgucaaccccgacaccggccgggugcuguucgagugcaagcuccacaagagcggguacgugaccgucgcccacaccggccagcacgaccuggugaucccgcccaacggguacuuccgcuucgacuccugggugaaccaguucuacacccuggcccccaugggcaacggcacggggcgccggcgcgcggucuga

SEQ ID NO: 8830 - RNA, 1623 nt, Artificial Sequence
  derived and/or modified sequence opt1 from capsid_protein_VP1__Norovirus__ADI45818
augaagauggccagcuccgacgcccaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcguacaccggccagcacgaccuggucaucccgcccaacggguacuuccgguucgacagcugggugaaccaguucuacacccuggcccccaugggcaacgggacgggccgccgccgggcccucuga

SEQ ID NO: 8831 - RNA, 1626 nt, Artificial Sequence
  derived and/or modified sequence opt1 from capsid_protein_VP1__Norovirus__AET79296
augcgcaugagcgacggcgccgcccccaaggcgaacggguccgaggccagcggccaggaccuggugccgaccgccgucgagcaggccgugcccauccagcccguggccggggcgucccucgccgcccccgccgcgggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgccggcaacgcguucaccgccgggaaggugguggucgcccuggugccgcccuacuuccccaagggcucccugaccaccgcccagaucacgugcuucccccacgugaugugcgacguccgcacccucgagcccauccagcugccccugcucgacgugcggcgcgugcuguggcacgccacccaggaccaggaggagagcaugcggcuggucugcaugcucuacaccccgcugcgcacgaacucccccggcgacgagagcuucgugguguccgggcggcugcucagcaagcccgcggccgacuucaacuucgucuaccugacgcccccgaucgagcgcaccaucuaccggaugguggaccugcccgugcuccagccccgccugugcacccacgcccgguggcccgccccggucuacggccugcucguggaccccucccugcccagcaacccccaguggcagaacgggcgcgugcacgucgacggcacccugcucggcaccaccccgguguccgggagcugggucuccugcuucgccgcggaggccgccuacgaguuccagagcggcaccggggagguggccacguucacccugaucgagcaggacggcuccgccuacgugcccggggaccgggcggcgccccugggcuacccggacuucagcggccagcucgagaucgagguccagaccgagaccacgaaggccggggacaagcugaaggugaccaccuucgagaugauccugggccccaccacgaacguggaccaggcccccuaccaggggcgcguccacgccagcaccuccgugaccgccagccucaaccugguggacggccggguccgcgccgugccccgguccaucuacagcuuccaggacguggucccggaguacaacgacgggcugcucgugccccuggccccgcccaucggccccuuccugcccggcgaggugcuccugcgcuuccggaccuacaugcgccagaucgacuccagcgacgccgcggccgaggccaucgacugcgcccugccccaggaguucaucuccugguucgccagcaacgcguucacgguccaguccgaggcccuccugcugcgguaccgcaacacccucaccgggcagcugcuguucgagugcaagcuguacagcgagggcuacaucgcccucuccuacagcggguccggcccccugaccuucccgacggacggguucuucgagguggugagcugggucccccgccuguaccagcucgccuccgugggcagccuggccaccggccggacccugaagcaguga

SEQ ID NO: 8832 - RNA, 1626 nt, Artificial Sequence
  derived and/or modified sequence opt1 from capsid_protein_VP1__Norovirus__AFB18026
augcgcaugagcgacggcgccacccccaagccgaacggguccgaggccgcgggccaggaccuggugcccagcuccgucgagcaggccauccccauccagcccguggccggggccgccguggcggccccgaccgccggccagaucaaccagaucgaccccuggaucuuccagaacuucguccagugcccccucggggaguucagcaucagcccccggaacacgccgggcgagauccuguucgaccuggcccucggccccgggcugaaccccuaccuggcgcaccucuccgccauguacaccggcuggguggggaacauggaggugcagcugguccuggccggcaacgccuucaccgccgggaaggugguggucgcgcucgugcccccguacuucccccagggcucccugaccacggcccagaucacgugcuucccccacgugaugugcgacguccgcacccuggagcccauccagcucccgcugcuggacgugcggcgcgugcucuggcacgccacccagaaccaggaggaggccaugcggcuggucugcaugcuguacacgccccuccgcaccaacagccccggcgacgaguccuucguggugagcgggcggcugcugucccgccccagcccggacuucaacuucgucuaccucaccccgcccaucgagcggaccaucuaccgcaugguggaccugcccgugguccagccccggcugugcacccacucccgcuggcccgcccccguguaccagauccucguggaccccagccugccguccaacccccaguggcagaacggccggguccugaucgacgggacccuccugggcaccacccccaucagcuccagcuggguggcguccuucgccggcacggccgaguacagcuuccagagcccgcccuccgccgagaucggggaggucagccuguucgagaucgacggcuccgccuacacccccggggaccgcgcggcgccccucggcuacccggacuucagcgggacccuggagguggagauccagaccgagacgaccaaggccggccagaagcuggacgugcacaccuucaaccucgagcugaagucccagaccgucgaccaggcccccuuccagggcaagguguacauggaccuggaggccagcgccucccucgaccuggugaacgggcggguccgcgccagcccccgguccguggccgccuucaaggacgagcugcccagcuacaacuccggccuccuggugccgcuggcgccgccccucgggcccuuccugcccggcgagguccugcuccgcuuccggacguucgcccgccagguggacaccaccgacgccagcgcccaggccguggacugcgcgcugccccaggagcuggucuccugguucgccagcuccaacuucaccgugcagagcgaggcccuccugcugcgguaccgcaacacgcugaccgggcagcuccuguucgagugcaagcuguacuccgagggcuacaucgcccucagcuacaccggcuccagcccccugaccuuccccacggacggguuccuggagguggucagcugggugccgcgccuccaccagcuggccuccgugggcagccuggcgaccgggcggucccucaagcaguga

SEQ ID NO: 8833 - RNA, 1626 nt, Artificial Sequence
  derived and/or modified sequence opt1 from capsid_protein_VP1__Norovirus__AFB18027
augcgcaugagcgacggcgccacccccaagccgaacggguccgaggccgcgggccaggaccuggugcccagcuccgucgagcaggccauccccauccagcccguggccggggccgccguggcggccccgaccgccggccagaucaaccagaucgaccccuggaucuuccagaacuucguccagugcccccucggggaguucagcaucagcccccggaacacgccgggcgagauccuguucgaccuggcccucggccccgggcugaaccccuaccuggcgcaccucuccgccauguacaccggcuggguggggaacauggaggugcagcugguccuggccggcaacgccuucaccgccgggaaggugguggucgcgcucgugcccccguacuuccccaagggcucccugaccacggcccagaucacgugcuucccccacgugaugugcgacguccgcacccuggagcccauccagcucccgcugcuggacgugcggcgcgugcucuggcacgccacccaggaccaggaggaggccaugcggcuggucugcaugcuguacacgccccuccgcaccaacagccccggcgacgaguccuucguggugagcgggcggcugcugucccgccccgccagcgacuucaacuucgucuaccucaccccgcccaucgagcggaccaucuaccgcaugguggaccugcccgugguccagccccggcugugcacccacucccgcuggccggcgcccguguaccagauccucguggaccccagccugcccuccaacccgcaguggcagaacggccggguccagguggacgggacccugcucggcaccacccccgucagcggcuccuggguggccagcuucgccgggacggccgaguacuccuuccagacgcccccgagcgccgagaucggcaccaucagccuguucgagaucgacggguccgcguacgugcccggcgaccgcgccgcgccccugggguaccccgacagcgccggcacccucgaggucgagauccagaccgagaccaccaaggccggccagaagcugaacgugcacaccuucucccuggagcucgugagccagacggucgaccaggccccguaccaggggcagaucuucguggaccuggagaccuccagcuccauggaccuggugaacggccggguccgcgccagcccccgguccaucagcggguucaaggacgagcuccccuccuacaacaacggccugcuggugccccucgccccgccccuggggcccuuccugcccggcgaggugcuccugcgcuuccggaccuucgccggccaggucgaccugaccgacgcggccgcccagccgguggacugcgcccucccccaggaguucgugagcugguucgccuccaacaacuucacgguccagagcgaggcgcugcugcuccgcuaccggaacacccugaccgggcagcugcuguucgagugcaagcucuacuccgagggcuacaucgcccugagcuacaccggguccggcccccugacguuccccaccgacggguucuucgagguggugagcugggucccgcgccucuaccagcuggccuccgugggcagccuggccaccggccgcagccucaagcaguga

SEQ ID NO: 8834 - RNA, 1635 nt, Artificial Sequence
  derived and/or modified sequence opt1 from capsid_protein_VP1__Norovirus__AFI08231
augaugauggccagcaaggacgcccccaccaacauggacggcaccuccggggcgggccagcuggugccggaggccaacacggccgagcccaucagcauggaccccgucgccggggccgcgaccgccguggccaccgccggccagaucaacaugaucgaccccuggaucauguccaacuucgugcaggcgccgcagggggaguucaccgucagccccaacaacacgcccggcgacguccucuucgaccugcagcugggcccccagcucaacccguuccuggcccaccuggcccagauguacaacgggugggugggcaacaugcgcgugaaggugcuccuggccgggaacgccuucaccgcgggcaagaucaucaucuccugcaucccgcccggguucaccagccagaacaucuccaucgcccagaugaccauguucccccacgugaucgccgacguccgggugcuggagcccaucgagaucccccucgaggacgugcgcaacguccuguuccacacgaacgacaaccggcccaccaugcgccuggugugcaugcucuacacgccccugcgggccaacggcagcuccagcggcaccgacccguucgugaucgccgggcgcguccugaccugccccgacuccaacuucagcuuccucuuccuggugccgcccaacguggagcagaagacccggcccuucuccguccccaacaucccccugaacacccucagcaacucccgcgugcccagccugaucaaguccaugaccaucagccgggaccagaaccagaucauccaguuccagaacggccgcgugacgcuggacgggcagcuccagggcaccaccccgaccuccgucagccagcugugcaagauccggggcacgaccuaccacgcgaccgggggcaacgggaucaaccugaccgagcucaacggcgagcccuaccacgccuucgagagccccgcccccaucggguucccggaccugggcggcugcgacuggcaccugacggccacccccacccaggccuucaacgacggggcgaagguggugcgccucuccgucacccagggcgccgccuucgcgccccaccuggggacgauccacuacaccaccaccgacacggacuacaacccgaacaccagcaucaucugcacccuggacuggcucucccagaccgccggccagagcaacguggaccccuggcagauccccacguacggguccacccugaccgaggccgcccagcuggcgcccccgaucuucccgcccggcuucggcgagacccucgucuucuuccugagcgacuuccccaucuccaacgggaagaacggccugagcgugcccugcacccucccccaggaguucgugacgcacuucgucaacgagcaggcccccauccgcggggaggccgcccugcugcacuacguggaccccgacacccaccggaaccucggcgaguucaagcuguacccggagggguucaugaccugcgugcccaacaccuccggcggcgggccccagacgcugcccaucaacggcgucuucguguucgugagcugggucucccgguucuaccagcucaagccgguggggaccgccggcgccgcccgccggcugggcauccgccggagcuga

SEQ ID NO: 8835 - RNA, 1623 nt, Artificial Sequence
  derived and/or modified sequence opt1 from capsid_protein_VP1__Norovirus__AFI08240
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccgggacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcgcccuguga

SEQ ID NO: 8836 - RNA, 1620 nt, Artificial Sequence
  derived and/or modified sequence opt1 from capsid_protein_VP1__Norovirus__AFS33552
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucaccgccggcaaggugaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagccacgacuccacccugaagcucaucgccaugcuguacacgccccugcgggccaacaacgcgggcgacgacguguucaccgugagcugccgcguccucacccggcccuccccggacuucgacuucaucuuccuggugccgcccaccguggagagccgcaccaagcccuucacgguccccauccugaccguggaggagauguccaacagccgguuccccaucccccucgagaagcuguacaccggccccuccagcgccuucgugguccagccgcagaacgggcgcugcaccacggacggcgugcugcucgggaccacccagcuguccgccgucaacaucugcaacuuccggggcgacgugacccacaucgugggcagccacgacuacacgaugaaccuggccagccagaacugguccaacuacgaccccaccgaggagauccccgccccgcucgggacccccgacuucgucggcaagauccaggggcugcugacccagacgacccgcgcggacggcagcacccgggcccacaaggccaccguguccacggggagcgugcacuucacccccaagcucggcuccguccaguucaccaccgacacgaacaacgacuuccagaccggccagaacaccaaguucacccccgugggggugauccaggacggcgaccaccaccagaacgagccgcagcaguggguccugcccaacuacagcgggcgcacgggccacaacgugcaccuggcccccgccguggcgcccaccuucccgggggagcagcuccuguucuuccgguccaccaugcccggcugcagcggcuaccccaacaugaaccuggacugccuccugccccaggaguggguccugcacuucuaccaggaggccgccccggcccaguccgacguggcgcuccugcgcuucgugaaccccgacaccgggcggguccuguucgagugcaagcuccacaagagcggcuacaucacgguggcccacaccgggcccuacgaccuggugaucccgcccaacggcuacuuccgcuucgacuccugggucaaccaguucuacacccuggcccccauggggaacggcaccggccggcgccgggcccucuga

SEQ ID NO: 8837 - RNA, 1608 nt, Artificial Sequence
  derived and/or modified sequence opt1 from capsid_protein_VP1__Norovirus__AFS33555
augaagauggccagcaacgacgccgcgcccuccaacgacggcgccgccgggcuggugcccgaggucaacaacgagaccauggcccucgagcccguggccggcgcgagcaucgccgcgccccugaccgggcagaacaacgugaucgaccccuggauccgcaugaacuucguccaggccccgaacggcgaguucacggugagcccccggaacucccccggggagauccugcucaaccuggagcugggccccgagcucaacccguuccuggcccaccugucccgcauguacaacggcuacgccgggggcguggagguccaggugcuccuggccgggaacgccuucaccgccggcaagcugguguucgcggccaucccgccccacuucccccucgagaaccugagccccgggcagaucaccauguucccccacgucaucaucgacgugcggacccuggagcccgugcuccugccccugccggacguccgcaacaacuucuuccacuacaaccagcagcccgagccccggaugcgccucguggccaugcuguacacgccccugcgguccaacggcagcggcgacgacguguucaccgucuccugccgcgugcucacccggccgagccccgacuucgacuucaacuaccuggugccgcccaccgucgaguccaagacgaagcccuucacccugcccauccucaccaucggggagcugagcaacucccgcuuccccgugcccaucgacgagcuguacaccagcccgaacgagggcgugaucguccagccccagaacgggcgguccacgcucgacggcgagcugcugggcaccacccagcucgugcccagcaacaucugcgcccugcgcgggcggaucaacgcccaggugccggacgaccaccaccaguggaaccugcaggucaccaacacgaacggcacccccuucgaccccaccgaggacgugcccgcgccgcucgggacccccgacuuccuggccaacaucuacggcgucacgucccagcgcaaccccaacaacacgugccgggcccacgacggggugcuggccaccuggagccccaaguucaccccgaagcucggcuccgugauccugggcaccugggaggagagcgaccuggaccucaaccagcccacccgcuucacccccgucgggcuguucaacaccgaccacuucgaccagugggcccugcccagcuacuccggccggcucacgcugaacaugaaccuggcgccgagcgugagcccccucuuccccggggagcagcugcuguucuuccgcucccacaucccccucaagggcgggaccuccgacggcgccaucgacugccugcugccgcaggaguggauccagcacuucuaccaggagagcgcccccucccccaccgacguggcccugauccgguacaccaaccccgacacgggccgcguccucuucgaggccaagcugcaccggcagggguucaucaccguggcgaacagcggcucccgcccgaucguggucccgcccaacggguacuuccgcuucgacagcugggugaaccaguucuacucccuggcccccaugggcaccgggaacggccggcgccgggugcaguga

SEQ ID NO: 8838 - RNA, 1623 nt, Artificial Sequence
  derived and/or modified sequence opt1 from capsid_protein_VP1__Norovirus__AFW15938
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacgcccagaacguccaccuggccccggcgguggcccccaccuuccccggggagcagcuccucuucuuccgcuccacgaugcccggcugcagcggcuacccgaacauggaccuggacugccugcucccccaggagugggugcagcacuucuaccaggaggccgcccccgcgcaguccgacgucgcccugcugcgguucgugaaccccgacaccgggcgcguccucuucgagugcaagcugcacaagagcggcuacgugaccguggcccacaccgggcagcacgaccuggugaucccgcccaacggcuacuuccgguucgacuccugggucaaccaguucuacacccucgcccccauggggaacggcacgggccgccggcgcgcccuguga

SEQ ID NO: 8839 - RNA, 1623 nt, Artificial Sequence
  derived and/or modified sequence opt1 from capsid_protein_VP1__Norovirus__AFW15940
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagcaagaccaagcccuucacgguccccauccugaccguggaggagaugaccaacucccgcuuccccaucccccuggagaagcuguucaccggccccagcuccgccuucgugguccagccgcagaacgggcggugcacgaccgacggcgugcugcuggggaccacccagcucagccccgucaacaucugcacguuccgcggcgacgugacccacaucgccggcucccggaacuacaccaugaaccuggccagccugaacuggaacaacuacgaccccaccgaggagaucccggcgccccucgggacgcccgacuucgugggcaagauccaggggguccugacccagaccaccaagggcgacggguccacgcgcggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccggaacgagccccagcagugggugcuccccuccuacagcggccgcaacgcccagaacguccaccuggccccggcgguggcccccaccuuccccggggagcagcuccucuucuuccgguccacgaugcccggcugcagcggcuacccgaacauggaccuggacugccugcucccccaggagugggugcagcacuucuaccaggaggccgcccccgcgcaguccgacgucgcccugcugcgcuucgugaaccccgacaccgggcggguccucuucgagugcaagcugcacaagagcggcuacgugaccguggcccacaccgggcagcacgaccuggugaucccgcccaacggcuacuuccgcuucgacuccugggucaaccaguucuacacccucgcccccauggggaacggcacgggccggcgccgggcccuguga

SEQ ID NO: 8840 - RNA, 1623 nt, Artificial Sequence
  derived and/or modified sequence opt1 from capsid_protein_VP1__Norovirus__AFW15941
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacguccagaacgugcaccuggccccggccguggcgcccaccuuccccggggagcagcuccucuucuuccgcuccacgaugcccggcugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcgcccuguga

SEQ ID NO: 8841 - RNA, 1623 nt, Artificial Sequence
  derived and/or modified sequence opt1 from capsid_protein_VP1__Norovirus__AFW15944
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggagcuccuacgacccgaccgaggagauccccgcgccccuggggacgcccgacuucgucggcaagauccagggggugcucacccagaccacccggacgaacggcagcacccgcgggcacaaggccaccguguacaccggcuccgccgacuucagcccgaagcugggccggguccaguucgccacggacaccgacaacgacuucgagaccaaccagaacaccaaguucacgcccgugggggugauccaggacggcuccaccacgccccgcaacgagccccagcaguggguccugccgagcuacuccgggcggaacauccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggcggcccccgcccagagcgacguggcccuccugcgguucgugaacccggacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgggcccucuga

SEQ ID NO: 8842 - RNA, 1623 nt, Artificial Sequence
  derived and/or modified sequence opt1 from capsid_protein_VP1__Norovirus__AFW15947
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgggcccucuga

SEQ ID NO: 8843 - RNA, 1623 nt, Artificial Sequence
  derived and/or modified sequence opt1 from capsid_protein_VP1__Norovirus__AFW15948
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcaacgccuucgucgugcagccgcagaacgggcgcugcacgaccgacggcguccuccuggggaccacccagcucucccccgugaacaucugcacguuccggggcgacgugacccacauccccggcagccgcaacuacaccaugaaccuggccucccagaacuggaacagcuacgacccgaccgaggagauccccgcgccccuggggacgcccgacuucgucggcaagauccagggggugcucacccagaccacccggacgaacggcagcacccgcgggcacaaggccaccguguacaccggcuccgccgacuucagcccgaagcugggccggguccaguucgccacggacaccgacaacgacuucgagaccaaccagaacaccaaguucacgcccgugggggugauccaggacggcuccaccacgccccgcaacgagccccagcaguggguccugccgagcuacuccgggcggaacauccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggcggcccccgcccagagcgacguggcccuccugcgguucgugaacccggacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgggcccucuga

SEQ ID NO: 8844 - RNA, 1623 nt, Artificial Sequence; identical to SEQ ID NO: 8842
  derived and/or modified sequence opt1 from capsid_protein_VP1__Norovirus__AFW15949

SEQ ID NO: 8845 - RNA, 1623 nt, Artificial Sequence
  derived and/or modified sequence opt1 from capsid_protein_VP1__Norovirus__AFW15950
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacgugugcacguuccggggcgacgugacccacaucuccggcagccgcaacuacaccaugaaccuggccagccagaacuggaccuccuacgaccccacggaggagaucccggcgccccuggggacccccgacuucgucggcaagauccagggggugcucacccagaccacgcggaccaacggcagcacccgcgggcacaaggccaccguguacacgggcuccgccgacuucagccccaagcugggccggguccaguucgccaccgacaccgacaacgacuucgagaccaaccagaacacgaaguucaccccggugggggugauccaggacggcuccaccacgccccgcaacgagccccagcaguggguccugcccagcuacuccgggcggaacauccacaacgugcaccucgccccggccguggcccccaccuuccccggcgagcagcugcuguucuuccgcagcaccaugcccgggugcuccggcuacccgaacauggaccucgacugccugcugccccaggaguggguccaguacuucuaccaggaggcggcccccgcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacgcuggcccccaugggcaacgggaccggccgccgccgggcccucuga

SEQ ID NO: 8846 - RNA, 1623 nt, Artificial Sequence
  derived and/or modified sequence opt1 from capsid_protein_VP1__Norovirus__AFW15951
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucuccggcagccgcaacuacaccaugaaccuggccagccagaacuggaccuccuacgaccccacggaggagaucccggcgccccuggggacccccgacuucgugggcaagauccaggggguccucacccagaccacgcggaccaacggcagcacccgcgggcacaaggccaccguguacacgggcuccgccgacuucagccccaagcugggccgggugcaguucgccaccgacaccgacaacgacuucgagaccaaccagaacacgaaguucaccccggucggggugauccaggacggcuccaccacgccccgcaacgagccccagcagugggugcugcccagcuacuccgggcggaacauccacaacguccaccucgccccggccguggcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacgucgcccuccugcgguucgugaaccccgacaccggccgcgugcuguucgagugcaagcuccacaaguccggguacgucaccguggcgcacaccggccagcacgaccuggugaucccgcccaacggguacuuccgguucgacagcugggucaaccaguucuacacgcuggcccccaugggcaacgggaccggccgccgccgggcccucuga

SEQ ID NO: 8847 - RNA, 1653 nt, Artificial Sequence
  derived and/or modified sequence opt1 from capsid_protein_VP1__Norovirus__AFX71665
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggccgccaucgacaugcuguacaccgaccccaacgaguccaucguggugcagccccagaacggccgcugcacccuggacggcacgcuccaggggaccacccagcugguccccacccagaucugcgccuuccggggcacgcugaucagccagaccgcccgcgcggccgacuccaccgacagcccgcagcgggcccgcaaccacccccuccacgugcaggucaagaaccuggacgggacccaguacgaccccacggacgacaucccggccgugcugggcgccaucgacuuccagggcaccguguucggggucgcgucccagcgggacgugagcggccagcaggagcaggggcacuacgccacccgcgcccacgaggcccacaucgacaccacggaccccaaguacgcgcccaagcucggcaccauccugaucaaguccgacagcgacgacuucaacaccaaccagcccauccgguucaccccgguggggaugggcgacaacaacuggcgccagugggagcugcccgacuacagcggccggcucacgcugaacaugaaccuggcccccgccgucucccccagcuucccgggggagcgcauccucuucuuccgcuccaucgugcccagcgccggcggguacggcuccggguacaucgacugccugaucccccaggagugggugcagcacuucuaccaggaggccgcgcccagccaguccgccgucgcccuggugcgguacgugaacccggacaccggccgcaacaucuucgaggccaagcuccaccgggagggcuuccugaccgucgccaacagcgggaacaaccccaucguggugccgcccaacggcuacuuccgcuucgaggcgugggucaaccaguucuacacccuggcccccaugggguccggccaggggcggcgccgggcccaguga

SEQ ID NO: 8848 - RNA, 1623 nt, Artificial Sequence
  derived and/or modified sequence opt1 from capsid_protein_VP1__Norovirus__AFX71668
augaagauggccagcuccgacgccagccccuccgacggcagcaccgcgaaccuggugcccgaggucaacaacgaggugauggcccucgagcccguggccggggccgccaucgcggcccccgucgccggccagcagaacgugaucgaccccuggauccgcaacaacuucgugcaggcccccgggggcgaguucaccgucagcccccggaacgcgcccggggagauccugugguccgcgccccugggcccggaccucaaccccuaccugucccaccuggcccgcauguacaacggcuacgccgggggcuucgagguccaggugauccucgccgggaacgccuucacggccggcaagaucaucuucgccgccgugccgcccaacuucccgaccgaggggcugagccccucccaggugaccauguucccccacaucaucguggacguccggcagcuggagcccgugcucaucccgcugcccgacgugcgcaacaacuucuaccacuacaaccagcugaacgaccccaccaucaagcucaucgccaugcuguacacgccccugcgggcgaacaacgccggcgacgacgucuucaccgugagcugccgcgugcucacccggccgucccccgacuucgacuucaucuuccuggucccgcccaccguggagagccgcacgaagcccuucuccgugcccguccugaccguggaggagaugaccaacagccgguuccccaucccccucgagaagcuguucaccggcccguccagcgccuucgugguccagccccagaacgggcgcugcacgaccgacggcgugcugcucgggaccacccagcugucccccgucaacaucugcacguuccggggcgacgugacccacaucagcggcucccgcaacuacaccaugaaccuggccagccagaacuggaacagcuacgacccgaccgaggagauccccgcgccccucgggacgcccgacuucgugggcaagauccaggggguccugacccagaccacccggacgaacggcuccacccgcgggcacaaggccaccguguacaccggcagcgccgacuucuccccgaagcugggccgggugcaguucgccacggacaccgacaacgacuucgagaccaaccagaacaccaaguucacgcccgucggggugauccaggacggcaacaccacgccccgcaacgagccccagcagugggugcucccgagcuacuccgggcggaacauccagaacguccaccuggcccccgccguggcgcccaccuuccccggcgagcagcuccuguucuuccgcagcaccaugccggggugcuccggcuaccccaacauggaccuggacugccugcucccccaggagugggugcaguacuucuaccaggaggccgcccccgcccagagcgacgucgcgcugcugcgguucgugaacccggacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacgggacgggccgccgccgggcccuguga

SEQ ID NO: 8849 - RNA, 1623 nt, Artificial Sequence; identical to SEQ ID NO: 8835
  derived and/or modified sequence opt1 from capsid_protein_VP1__Norovirus__AFX81121

SEQ ID NO: 8850 - RNA, 1623 nt, Artificial Sequence; identical to SEQ ID NO: 8835
  derived and/or modified sequence opt1 from capsid_protein_VP1__Norovirus__AFX81127

SEQ ID NO: 8851 - RNA, 1623 nt, Artificial Sequence; identical to SEQ ID NO: 8835
  derived and/or modified sequence opt1 from capsid_protein_VP1__Norovirus__AFX81130

SEQ ID NO: 8852 - RNA, 1623 nt, Artificial Sequence; identical to SEQ ID NO: 8835
  derived and/or modified sequence opt1 from capsid_protein_VP1__Norovirus__AFX81136

SEQ ID NO: 8853 - RNA, 1623 nt, Artificial Sequence; identical to SEQ ID NO: 8835
  derived and/or modified sequence opt1 from capsid_protein_VP1__Norovirus__AFX81139

SEQ ID NO: 8854 - RNA, 1623 nt, Artificial Sequence; identical to SEQ ID NO: 8835
  derived and/or modified sequence opt1 from capsid_protein_VP1__Norovirus__AFX81142

SEQ ID NO: 8855 - RNA, 1623 nt, Artificial Sequence; identical to SEQ ID NO: 8835
  derived and/or modified sequence opt1 from capsid_protein_VP1__Norovirus__AFX81145

SEQ ID NO: 8856 - RNA, 1623 nt, Artificial Sequence; identical to SEQ ID NO: 8835
  derived and/or modified sequence opt1 from capsid_protein_VP1__Norovirus__AFX81148

SEQ ID NO: 8857 - RNA, 1623 nt, Artificial Sequence; identical to SEQ ID NO: 8835
  derived and/or modified sequence opt1 from capsid_protein_VP1__Norovirus__AFX81154

SEQ ID NO: 8858 - RNA, 1623 nt, Artificial Sequence; identical to SEQ ID NO: 8835
  derived and/or modified sequence opt1 from capsid_protein_VP1__Norovirus__AFX81157

SEQ ID NO: 8859 - RNA, 1623 nt, Artificial Sequence; identical to SEQ ID NO: 8835
  derived and/or modified sequence opt1 from capsid_protein_VP1__Norovirus__AFX81163

SEQ ID NO: 8860 - RNA, 1623 nt, Artificial Sequence
  derived and/or modified sequence opt1 from capsid_protein_VP1__Norovirus__AFX81166
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacgucccgaacgugcaccuggcccccgccguggcgcccaccuuccccggcgagcagcuccucuucuuccgcuccacgaugccgggcugcagcggguaccccaacauggaccuggacugccugcucccccaggaguggguccagcacuucuaccaggaggccgcccccgcccaguccgacguggcgcugcugcgguucgugaacccggacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 8861 - RNA, 1623 nt, Artificial Sequence; identical to SEQ ID NO: 8835
  derived and/or modified sequence opt1 from capsid_protein_VP1__Norovirus__AFX81169

SEQ ID NO: 8862 - RNA, 1623 nt, Artificial Sequence; identical to SEQ ID NO: 8835
  derived and/or modified sequence opt1 from capsid_protein_VP1__Norovirus__AFX81172

SEQ ID NO: 8863 - RNA, 1623 nt, Artificial Sequence; identical to SEQ ID NO: 8835
  derived and/or modified sequence opt1 from capsid_protein_VP1__Norovirus__AFX81178

SEQ ID NO: 8864 - RNA, 1623 nt, Artificial Sequence; identical to SEQ ID NO: 8835
  derived and/or modified sequence opt1 from capsid_protein_VP1__Norovirus__AFX81181

SEQ ID NO: 8865 - RNA, 1623 nt, Artificial Sequence; identical to SEQ ID NO: 8835
  derived and/or modified sequence opt1 from capsid_protein_VP1__Norovirus__AFX81190

SEQ ID NO: 8866 - RNA, 1623 nt, Artificial Sequence; identical to SEQ ID NO: 8835
  derived and/or modified sequence opt1 from capsid_protein_VP1__Norovirus__AFX81193

SEQ ID NO: 8867 - RNA, 1623 nt, Artificial Sequence; identical to SEQ ID NO: 8835
  derived and/or modified sequence opt1 from capsid_protein_VP1__Norovirus__AFX81196

SEQ ID NO: 8868 - RNA, 1623 nt, Artificial Sequence
  derived and/or modified sequence opt1 from capsid_protein_VP1__Norovirus__AFX81199
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcgacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccgggacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcgcccuguga

SEQ ID NO: 8869 - RNA, 1623 nt, Artificial Sequence; identical to SEQ ID NO: 8835
  derived and/or modified sequence opt1 from capsid_protein_VP1__Norovirus__AFX81202

SEQ ID NO: 8870 - RNA, 1623 nt, Artificial Sequence
  derived and/or modified sequence opt1 from capsid_protein_VP1__Norovirus__AFX81205
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggcccuccccuccuacagcggccgggacgugcacaacguccaccuggccccggcgguggcccccacguuccccggcgagcagcuccucuucuuccgcuccaccaugcccgggugcagcggcuacccgaacauggaccuggacugccugcucccccaggagugggugcagcacuucuaccaggaggccgcccccgcgcaguccgacgucgcccugcugcgguucgugaaccccgacaccgggcgcguccucuucgagugcaagcugcacaagagcggcuacgugaccguggcccacaccgggcagcacgaccuggugaucccgcccaacggcuacuuccgguucgacuccugggucaaccaguucuacacgcucgcccccaugggcaacgggaccggccgccggcgcgcccuguga

SEQ ID NO: 8871 - RNA, 1623 nt, Artificial Sequence; identical to SEQ ID NO: 8835
  derived and/or modified sequence opt1 from capsid_protein_VP1__Norovirus__AFX81208

SEQ ID NO: 8872 - RNA, 1623 nt, Artificial Sequence; identical to SEQ ID NO: 8835
  derived and/or modified sequence opt1 from capsid_protein_VP1__Norovirus__AFX81211

SEQ ID NO: 8873 - RNA, 1623 nt, Artificial Sequence; identical to SEQ ID NO: 8835
  derived and/or modified sequence opt1 from capsid_protein_VP1__Norovirus__AFX81214

SEQ ID NO: 8874 - RNA, 1623 nt, Artificial Sequence; identical to SEQ ID NO: 8835
  derived and/or modified sequence opt1 from capsid_protein_VP1__Norovirus__AFX81226

SEQ ID NO: 8875 - RNA, 1623 nt, Artificial Sequence
  derived and/or modified sequence opt1 from capsid_protein_VP1__Norovirus__AFX81229
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugucccuggccagccugaacuggaacaacuacgaccccacggaggagaucccggcgccccucggcacccccgacuucguggggaagauccagggcguccugacccagaccacgaagggggacggcuccacccggggccacaaggccaccguguacaccgggagcgcccccuucacgccgaagcugggcagcgugcaguucuccaccgacaccgagaacgacuucgagacccaccagaacacgaaguucacccccgucggggugauccaggacggcgggaccacccaccgcaacgagccccagcagugggugcuccccagcuacuccggccgggacguccacaacgugcaccuggccccggccguggcgcccacguuccccggcgagcagcuccucuucuuccgcagcaccaugcccgggugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacgcucgcccccaugggcaacgggaccggccgccggcgcgcccuguga

SEQ ID NO: 8876 - RNA, 1623 nt, Artificial Sequence; identical to SEQ ID NO: 8835
  derived and/or modified sequence opt1 from capsid_protein_VP1__Norovirus__AFX81232

SEQ ID NO: 8877 - RNA, 1623 nt, Artificial Sequence; identical to SEQ ID NO: 8835
  derived and/or modified sequence opt1 from capsid_protein_VP1__Norovirus__AFX81238

SEQ ID NO: 8878 - RNA, 1623 nt, Artificial Sequence
  derived and/or modified sequence opt1 from capsid_protein_VP1__Norovirus__AFX81241
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgggcccucuga

SEQ ID NO: 8879 - RNA, 1623 nt, Artificial Sequence
  derived and/or modified sequence opt1 from capsid_protein_VP1__Norovirus__AFX81247
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacugggacagcuacgaccccaccgaggagacgcccgcgccccuggggaccccggacuucgucggcaagauccagggggugcucacccagaccacgcggaccaacggcagcacccgcgggcacaaggccaccguguacacgggcuccgccgacuucagccccaagcugggccggguccaguucgccaccgacaccgacaacgacuucgagaccaaccagaacacgaaguucacccccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacgcuggcccccaugggcaacgggaccggccgccgccgggcccucuga

SEQ ID NO: 8880 - RNA, 1623 nt, Artificial Sequence
  derived and/or modified sequence opt1 from capsid_protein_VP1__Norovirus__AFX81250
augaagauggccagcuccgacgccaaccccagcaacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgagcucccacaacuacaccaugaaccuggccagccagaacuggaacagcuacgaccccaccgaggagauccccgcgccccugggcacgccggacuucgucgggaagauccagggcgugcucacccagaccacccgcacggacggguccacccggggccacaaggccaccguguacaccgggagcgccgacuucucccccaagcugggccgcguccaguucgccacggacaccgacaacgacuuccagaccaaccagaacaccaaguucacgcccgugggcgugauccaggacgggagcaccacgccccggaacgagccgcagcaguggguccugcccuccuacagcggccgcaacauccacaacgugcaccucgcccccgccguggcccccaccuucccgggggagcagcugcuguucuuccgguccaccaugcccggcugcagcggguaccccaacauggaccucgacugccugcugccccaggaguggguccaguacuucuaccaggaggcggccccggcccaguccgacguggcccuccugcgcuucgugaaccccgacaccggccggguccuguucgagugcaagcuccacaagagcggcuacgugaccguggcgcacaccgggcagcacgaccuggucaucccgcccaacggcuacuuccgcuucgacuccugggugaaccaguucuacacccuggcccccauggggaacggcacggggcggcgccgcgcccucuga

SEQ ID NO: 8881 - RNA, 1623 nt, Artificial Sequence; identical to SEQ ID NO: 8878
  derived and/or modified sequence opt1 from capsid_protein_VP1__Norovirus__AFX81253

SEQ ID NO: 8882 - RNA, 1623 nt, Artificial Sequence
  derived and/or modified sequence opt1 from capsid_protein_VP1__Norovirus__AFX81256
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgggcccucuga

SEQ ID NO: 8883 - RNA, 1623 nt, Artificial Sequence; identical to SEQ ID NO: 8835
  derived and/or modified sequence opt1 from capsid_protein_VP1__Norovirus__AFX81262

SEQ ID NO: 8884 - RNA, 1623 nt, Artificial Sequence; identical to SEQ ID NO: 8835
  derived and/or modified sequence opt1 from capsid_protein_VP1__Norovirus__AFX81265

SEQ ID NO: 8885 - RNA, 1623 nt, Artificial Sequence
  derived and/or modified sequence opt1 from capsid_protein_VP1__Norovirus__AFX81268
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcgggucauccucgccgggaacgccuucaccgccggcaagaucaucuucgccgccgugccgcccaacuucccgacggaggggcugucccccagccaggugaccauguucccccacaucaucgucgacgugcgccagcuggagcccgugcucaucccgcugcccgacguccggaacaacuucuaccacuacaaccagaccaacgacuccaccaucaagcugaucgccaugcucuacacgccccugcgcgcgaacaacgccggcgaggacguguucaccgugagcugccggguccugacccgccccuccccggacuucgacuucaucuuccucgugccgcccaccguggagagccggacgaagcccuucaccguccccauccugaccguggaggagaugaccaacucccgcuuccccaucccccuggagaagcuguucacgggccccagcggggccuucgugguccagccgcagaacggccggugcaccaccgacggggugcugcugggcaccacgcagcucucccccgucaacaucugcaccuuccgcggcgacgugacccacaucgccgggagccggaacuacaccaugaaccuggccucccugaacuggaacaacuacgaccccacggaggagaucccggcgccccucggcacccccgacuucguggggaagauccagggcguccugacccagaccacgaagggggacggcagcacccgcggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccggaacgagccccagcagugggugcuccccuccuacagcggccgcgacguccacaacgugcaccuggccccggccguggcgcccacguuccccggcgagcagcuccucuucuuccgguccaccaugcccgggugcagcggcuacccgaacauggaccuggacugccugcucccccaggaguggguccagcacuucuaccaggaggccgcccccgcccaguccgacguggcgcugcugcgcuucgugaaccccgacaccgggcggguccucuucgagugcaagcugcacaagagcggcuacgugaccguggcccacaccgggcagcacgaccuggucaucccgcccaacggcuacuuccgcuucgacuccugggugaaccaguucuacacgcucgcccccaugggcaacgggaccggccggcgccgcgcccuguga

SEQ ID NO: 8886 - RNA, 1623 nt, Artificial Sequence; identical to SEQ ID NO: 8835
  derived and/or modified sequence opt1 from capsid_protein_VP1__Norovirus__AFX81271

SEQ ID NO: 8887 - RNA, 1623 nt, Artificial Sequence
  derived and/or modified sequence opt1 from capsid_protein_VP1__Norovirus__AFX81274
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcgggucauccucgccgggaacgccuucaccgccggcaagaucaucuucgccgccgugccgcccaacuucccgacggaggggcugucccccagccaggugaccauguucccccacaucaucgucgacgugcgccagcuggagcccgugcucaucccgcugcccgacguccggaacaacuucuaccacuacaaccagaccaacgacuccaccaucaagcugaucgccaugcucuacacgccccugcgcgcgaacaacgccggcgaggacguguucaccgugagcugccggguccugacccgccccuccccggacuucgacuucaucuuccucgugccgcccaccguggagagccggacgaagcccuucaccguccccauccugaccguggaggagaugaccaacucccgcuuccccaucccccuggagaagcuguucacgggccccagcggggccuucgugguccagccgcagaacggccggugcaccaccgacggggugcugcugggcaccacgcagcucucccccgucagcaucugcaccuuccgcggcgacgugacccacaucgccgggucccggaacuacaccaugaaccuggccagccugaacuggaacaacuacgaccccacggaggagaucccggcgccccucggcacccccgacuucguggggaagauccagggcguccugacccagaccacgaagggggacggcuccacccgcggccacaaggccaccguguacaccgggagcgcccccuucacgccgaagcugggcagcgugcaguucuccaccgacaccgagaacgacuucgagacccaccagaacacgaaguucacccccgucggggugauccaggacggcgggaccacccaccggaacgagccccagcagugggugcuccccagcuacuccggccgcgacguccacaacgugcaccuggccccggccguggcgcccacguuccccggcgagcagcuccucuucuuccggagcaccaugcccgggugcuccggcuacccgaacauggaccuggacugccugcucccccaggaguggguccagcacuucuaccaggaggccgcccccgcccagagcgacguggcgcugcugcgcuucgugaaccccgacaccgggcggguccucuucgagugcaagcugcacaaguccggcuacgugaccguggcccacaccgggcagcacgaccuggucaucccgcccaacggcuacuuccgcuucgacagcugggugaaccaguucuacacgcucgcccccaugggcaacgggaccggccggcgccgcgcccuguga

SEQ ID NO: 8888 - RNA, 1623 nt, Artificial Sequence; identical to SEQ ID NO: 8885
  derived and/or modified sequence opt1 from capsid_protein_VP1__Norovirus__AFX81277

SEQ ID NO: 8889 - RNA, 1623 nt, Artificial Sequence
  derived and/or modified sequence opt1 from capsid_protein_VP1__Norovirus__AFX81283
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcuccaccacccaccgcaacgagccccagcagugggugcuccccagcuacuccgggcgggacguccacaacgugcaccuggccccggccguggcgcccacguuccccggcgagcagcuccucuucuuccgcagcaccaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacgcucgcccccaugggcaacggcaccgggcgccggcgcgcccuguga

SEQ ID NO: 8890 - RNA, 1623 nt, Artificial Sequence; identical to SEQ ID NO: 8835
  derived and/or modified sequence opt1 from capsid_protein_VP1__Norovirus__AFX81289

SEQ ID NO: 8891 - RNA, 1623 nt, Artificial Sequence; identical to SEQ ID NO: 8835
  derived and/or modified sequence opt1 from capsid_protein_VP1__Norovirus__AFX81292

SEQ ID NO: 8892 - RNA, 1623 nt, Artificial Sequence; identical to SEQ ID NO: 8835
  derived and/or modified sequence opt1 from capsid_protein_VP1__Norovirus__AFX81295

SEQ ID NO: 8893 - RNA, 1623 nt, Artificial Sequence; identical to SEQ ID NO: 8835
  derived and/or modified sequence opt1 from capsid_protein_VP1__Norovirus__AFX81298

SEQ ID NO: 8894 - RNA, 1623 nt, Artificial Sequence
  derived and/or modified sequence opt1 from capsid_protein_VP1__Norovirus__AFX81301
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacggguccaccacccaccgcaacgagccccagcagugggugcuccccagcuacuccggccggaacgucccgaacgugcaccuggcccccgccguggcgcccaccuuccccggggagcagcuccucuucuuccgcagcacgaugccgggcugcuccggcuaccccaacauggaccuggacugccugcucccccaggaguggguccagcacuucuaccaggaggccgcccccgcccagagcgacguggcgcugcugcgguucgugaacccggacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcccuguga

SEQ ID NO: 8895 - RNA, 1623 nt, Artificial Sequence; identical to SEQ ID NO: 8835
  derived and/or modified sequence opt1 from capsid_protein_VP1__Norovirus__AFX81304

SEQ ID NO: 8896 - RNA, 1623 nt, Artificial Sequence; identical to SEQ ID NO: 8835
  derived and/or modified sequence opt1 from capsid_protein_VP1__Norovirus__AFX81307

SEQ ID NO: 8897 - RNA, 1623 nt, Artificial Sequence; identical to SEQ ID NO: 8835
  derived and/or modified sequence opt1 from capsid_protein_VP1__Norovirus__AFX81313

SEQ ID NO: 8898 - RNA, 1623 nt, Artificial Sequence; identical to SEQ ID NO: 8835
  derived and/or modified sequence opt1 from capsid_protein_VP1__Norovirus__AFX81316

SEQ ID NO: 8899 - RNA, 1623 nt, Artificial Sequence; identical to SEQ ID NO: 8835
  derived and/or modified sequence opt1 from capsid_protein_VP1__Norovirus__AFX81319

SEQ ID NO: 8900 - RNA, 1623 nt, Artificial Sequence; identical to SEQ ID NO: 8835
  derived and/or modified sequence opt1 from capsid_protein_VP1__Norovirus__AFX81322

SEQ ID NO: 8901 - RNA, 1623 nt, Artificial Sequence; identical to SEQ ID NO: 8835
  derived and/or modified sequence opt1 from capsid_protein_VP1__Norovirus__AFX81325

SEQ ID NO: 8902 - RNA, 1623 nt, Artificial Sequence; identical to SEQ ID NO: 8835
  derived and/or modified sequence opt1 from capsid_protein_VP1__Norovirus__AGE89433

SEQ ID NO: 8903 - RNA, 1623 nt, Artificial Sequence; identical to SEQ ID NO: 8835
  derived and/or modified sequence opt1 from capsid_protein_VP1__Norovirus__AGE89436

SEQ ID NO: 8904 - RNA, 1623 nt, Artificial Sequence; identical to SEQ ID NO: 8882
  derived and/or modified sequence opt1 from capsid_protein_VP1__Norovirus__AGE89439

SEQ ID NO: 8905 - RNA, 1623 nt, Artificial Sequence
  derived and/or modified sequence opt1 from capsid_protein_VP1__Norovirus__AGE89442
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucccgggcucccgcaacuacaccaugaaccuggccagccagaacuggaacagcuacgaccccaccgaggagauccccgcgccccuggggacgccggacuucgucggcaagauccagggggugcucacccagaccacccggacggacggcuccacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacccaccgcaacgagccccagcaguggguccugccguccuacagcgggcgggacgugcacaacgugcaccucgcccccgccgucgcccccaccuuccccggcgagcagcugcuguucuuccgcuccacgaugccggggugcagcggcuaccccaacauggaccucgacugccugcugccccaggagugggugcaguacuucuaccaggaggcggcccccgcccaguccgacguggcccuccugcgguucgucaacccggacaccggccgcgugcuguucgagugcaagcuccacaagagcggguacgugaccgucgcgcacaccggccagcacgaccuggugaucccgcccaacggguacuuccgguucgacuccugggugaaccaguucuacacccuggcccccaugggcaacgggacgggccgccgccgggcccucuga

SEQ ID NO: 8906 - RNA, 1623 nt, Artificial Sequence
  derived and/or modified sequence opt1 from capsid_protein_VP1__Norovirus__AGE89445
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucccgggcucccgcaacuacaccaugaaccuggccagccagaacuggaacagcuacgaccccaccgaggagauccccgcgccccuggggacgccggacuucgucggcaagauccagggggugcucacccagaccacccggacgaacggcuccacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccugcccuccuacagcgggcggaacauccacaacgugcaccucgcccccgccguggcccccaccuucccgggcgagcagcugcuguucuuccgcuccaccaugcccgggugcagcggcuaccccaacauggaccucgacugccugcugccccaggaguggguccaguacuucuaccaggaggcggccccggcccaguccgacguggcccuccugcgguucgugaaccccgacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgggcccucuga

SEQ ID NO: 8907 - RNA, 1623 nt, Artificial Sequence; identical to SEQ ID NO: 8882
  derived and/or modified sequence opt1 from capsid_protein_VP1__Norovirus__AGE89448

SEQ ID NO: 8908 - RNA, 1623 nt, Artificial Sequence; identical to SEQ ID NO: 8835
  derived and/or modified sequence opt1 from capsid_protein_VP1__Norovirus__AGE89451

SEQ ID NO: 8909 - RNA, 1623 nt, Artificial Sequence
  derived and/or modified sequence opt1 from capsid_protein_VP1__Norovirus__AGE89454
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccuguggggcgcgccccugggcccggaccucaaccccuaccugucccaccuggcccgcauguacaacggguacgccggcggguucgaggugcaggucauccucgccggcaacgccuucaccgccgggaagaucaucuucgccgccgugccgcccaacuucccgacggagggccugagccccucccaggugaccauguucccccacaucaucgucgacgugcggcagcuggagcccgugcucaucccgcugcccgacguccgcaacaacuucuaccacuacaaccagaccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacggggcccuccggcgccuucgugguccagccgcagaacgggcgcugcaccaccgacggcgugcugcugggcaccacgcagcucagccccgucaacaucugcaccuuccgcggggacgugacccacaucgccggcucccggaacuacaccaugaaccuggccagccugaacuggaacaacuacgaccccacggaggagaucccggcgccccucgggacccccgacuucgugggcaagauccaggggguccugacccagaccacgaagggcgacggcuccacccgggggcacaaggccaccguguacaccggcagcgcccccuucacgccgaagcugggguccgugcaguucagcaccgacaccgagaacgacuucgagacccaccagaacacgaaguucacccccgucggcgugauccaggacgggggcaccacccaccgcaacgagccccagcagugggugcuccccagcuacuccggccgggacguccacaacgugcaccuggccccggccguggcgcccacguuccccggggagcagcuccucuucuuccgcagcaccaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaacggccagcacgaccuggucaucccgcccaacggcuacuuccgguucgacagcugggugaaccaguucuacacccucgcccccauggggaacggcacggggcgccggcgcgcccuguga

SEQ ID NO: 8910 - RNA, 1623 nt, Artificial Sequence; identical to SEQ ID NO: 8835
  derived and/or modified sequence opt1 from capsid_protein_VP1__Norovirus__AGE89457

SEQ ID NO: 8911 - RNA, 1623 nt, Artificial Sequence; identical to SEQ ID NO: 8835
  derived and/or modified sequence opt1 from capsid_protein_VP1__Norovirus__AGE89460

SEQ ID NO: 8912 - RNA, 1623 nt, Artificial Sequence; identical to SEQ ID NO: 8835
  derived and/or modified sequence opt1 from capsid_protein_VP1__Norovirus__AGE89463

SEQ ID NO: 8913 - RNA, 1623 nt, Artificial Sequence; identical to SEQ ID NO: 8835
  derived and/or modified sequence opt1 from capsid_protein_VP1__Norovirus__AGE89466

SEQ ID NO: 8914 - RNA, 1623 nt, Artificial Sequence; identical to SEQ ID NO: 8909
  derived and/or modified sequence opt1 from capsid_protein_VP1__Norovirus__AGE89472

SEQ ID NO: 8915 - RNA, 1623 nt, Artificial Sequence; identical to SEQ ID NO: 8885
  derived and/or modified sequence opt1 from capsid_protein_VP1__Norovirus__AGE89475

SEQ ID NO: 8916 - RNA, 1623 nt, Artificial Sequence; identical to SEQ ID NO: 8835
  derived and/or modified sequence opt1 from capsid_protein_VP1__Norovirus__AGE89478

SEQ ID NO: 8917 - RNA, 1623 nt, Artificial Sequence
  derived and/or modified sequence opt1 from capsid_protein_VP1__Norovirus__AGE89481
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaaggaggacgggagcacccggggccacaaggccaccguguacaccggcuccgcccccuucacgccgaagcuggggagcgugcaguucagcaccgacaccgagaacgacuucgagacccaccagaacacgaaguucacccccgucggcgugauccaggacgggggcaccacccaccgcaacgagccccagcagugggugcuccccuccuacagcgggcgggacguccacaacgugcaccuggccccggccguggcgcccacguuccccggcgagcagcuccucuucuuccgcuccaccaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacgcucgcccccaugggcaacggcaccgggcgccggcgcgcccuguga

SEQ ID NO: 8918 - RNA, 1623 nt, Artificial Sequence; identical to SEQ ID NO: 8835
  derived and/or modified sequence opt1 from capsid_protein_VP1__Norovirus__AGE89490

SEQ ID NO: 8919 - RNA, 1623 nt, Artificial Sequence; identical to SEQ ID NO: 8835
  derived and/or modified sequence opt1 from capsid_protein_VP1__Norovirus__AGE89493

SEQ ID NO: 8920 - RNA, 1623 nt, Artificial Sequence
  derived and/or modified sequence opt1 from capsid_protein_VP1__Norovirus__AGE89496
augaagauggccagcaacgacgccaaccccuccgacggcagcgcggccaaccuggugcccgaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccgggacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagccgggcuacgugaccguggcccacaccgggcagcacgaccuggucaucccgcccaacggcuacuuccgguucgacagcugggugaaccaguucuacacgcucgcccccaugggcaacgggaccggccgccggcgcgcccuguga

SEQ ID NO: 8921 - RNA, 1623 nt, Artificial Sequence; identical to SEQ ID NO: 8835
  derived and/or modified sequence opt1 from capsid_protein_VP1__Norovirus__AGE89499

SEQ ID NO: 8922 - RNA, 1623 nt, Artificial Sequence
  derived and/or modified sequence opt1 from capsid_protein_VP1__Norovirus__AGE89502
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcgccuuccggggcgacgugacccacaucgccgggagccgcaacuacaccaugaaccuggcgucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccgcaacgagccccagcagugggugcuccccuccuacagcggccgggacguccacaacgugcaccuggccccggccguggcccccaccuuccccggcgagcagcuccucuucuuccgcuccacgaugcccgggugcagcggcuacccgaacauggaccuggacugccugcucccccaggaguggguccagcacuucuaccaggaggccgcccccgcgcaguccgacguggcccugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcgcccuguga

SEQ ID NO: 8923 - RNA, 1623 nt, Artificial Sequence; identical to SEQ ID NO: 8835
  derived and/or modified sequence opt1 from capsid_protein_VP1__Norovirus__AGE89505

SEQ ID NO: 8924 - RNA, 1623 nt, Artificial Sequence
  derived and/or modified sequence opt1 from capsid_protein_VP1__Norovirus__AGE89508
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcgacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgaggcccaccagaacaccaaguucacccccgucggggugauccaggacggcgggacgacccaccgcaacgagccccagcagugggugcuccccuccuacagcggccgggacguccacaacgugcaccuggccccggcgguggcccccaccuuccccggcgagcagcuccucuucuuccgcuccaccaugcccgggugcagcggcuacccgaacauggaccuggacugccugcucccccaggaguggguccagcacuucuaccaggaggccgcccccgcgcaguccgacguggcccugcugcgguucgugaaccccgacacggggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggaccggccgccggcgcgcccuguga

SEQ ID NO: 8925 - RNA, 1623 nt, Artificial Sequence; identical to SEQ ID NO: 8835
  derived and/or modified sequence opt1 from capsid_protein_VP1__Norovirus__AGE89511

SEQ ID NO: 8926 - RNA, 1623 nt, Artificial Sequence; identical to SEQ ID NO: 8835
  derived and/or modified sequence opt1 from capsid_protein_VP1__Norovirus__AGE89514

SEQ ID NO: 8927 - RNA, 1623 nt, Artificial Sequence; identical to SEQ ID NO: 8835
  derived and/or modified sequence opt1 from capsid_protein_VP1__Norovirus__AGE89517

SEQ ID NO: 8928 - RNA, 1623 nt, Artificial Sequence; identical to SEQ ID NO: 8922
  derived and/or modified sequence opt1 from capsid_protein_VP1__Norovirus__AGE89520

SEQ ID NO: 8929 - RNA, 1623 nt, Artificial Sequence; identical to SEQ ID NO: 8835
  derived and/or modified sequence opt1 from capsid_protein_VP1__Norovirus__AGE89523

SEQ ID NO: 8930 - RNA, 1623 nt, Artificial Sequence; identical to SEQ ID NO: 8835
  derived and/or modified sequence opt1 from capsid_protein_VP1__Norovirus__AGE89526

SEQ ID NO: 8931 - RNA, 1623 nt, Artificial Sequence; identical to SEQ ID NO: 8917
  derived and/or modified sequence opt1 from capsid_protein_VP1__Norovirus__AGE89529

SEQ ID NO: 8932 - RNA, 1623 nt, Artificial Sequence; identical to SEQ ID NO: 8835
  derived and/or modified sequence opt1 from capsid_protein_VP1__Norovirus__AGE89532

SEQ ID NO: 8933 - RNA, 1623 nt, Artificial Sequence; identical to SEQ ID NO: 8885
  derived and/or modified sequence opt1 from capsid_protein_VP1__Norovirus__AGE89535

SEQ ID NO: 8934 - RNA, 1623 nt, Artificial Sequence
  derived and/or modified sequence opt1 from capsid_protein_VP1__Norovirus__AGE89538
augaagauggccagcaacgacgccaaccccuccgacggcagcgcggccucccuggugccggaggucagcaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagaccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccggggccuucgugguccagccgcagaacggccgcugcaccaccgacggggugcugcugggcaccacgcagcucagccccgucaacaucugcaccuuccggggcgacgugacccacaucgccgggucccgcaacuacaccaugaaccuggccagccugaacuggaacaacuacgaccccacggaggagaucccggcgccccucggcacccccgacuucguggggaagauccagggcguccugacccagaccacgaagggggacggcuccacccggggccacaaggccaccguguacaccgggagcgcccccuucacgccgaagcugggcagcgugcaguucuccaccgacaccgagaacgacuucgagacccaccagaacacgaaguucacccccgucggggugauccaggacggcgggaccacccaccgcaacgagccccagcagugggugcuccccagcuacuccggccgggacguccacaacgugcaccuggccccggccguggcgcccacguuccccggcgagcagcuccucuucuuccgcagcaccaugcccgggugcuccggcuacccgaacauggaccuggacugccugcucccccaggaguggguccagcacuucuaccaggaggccgcccccgcccagagcgacgcggcccugcugcgguucgugaaccccgacaccgggcgcguccucuucgagugcaagcugcacaaguccggcuacgugaccguggcccacaccgggcagcacgaccuggugaucccgcccaacggcuacuuccgguucgacagcugggucaaccaguucuacacgcucgcccccaugggcaacgggaccggccgccggcgcgcccuguga

SEQ ID NO: 8935 - RNA, 1623 nt, Artificial Sequence; identical to SEQ ID NO: 8835
  derived and/or modified sequence opt1 from capsid_protein_VP1__Norovirus__AGE89541

SEQ ID NO: 8936 - RNA, 1623 nt, Artificial Sequence; identical to SEQ ID NO: 8835
  derived and/or modified sequence opt1 from capsid_protein_VP1__Norovirus__AGE89544

SEQ ID NO: 8937 - RNA, 1623 nt, Artificial Sequence; identical to SEQ ID NO: 8889
  derived and/or modified sequence opt1 from capsid_protein_VP1__Norovirus__AGE89547

SEQ ID NO: 8938 - RNA, 1623 nt, Artificial Sequence; identical to SEQ ID NO: 8868
  derived and/or modified sequence opt1 from capsid_protein_VP1__Norovirus__AGE89550

SEQ ID NO: 8939 - RNA, 1623 nt, Artificial Sequence
  derived and/or modified sequence opt1 from capsid_protein_VP1__Norovirus__AGE89553
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgaggcccaccagaacaccaaguucacccccgucggggugauccaggacggcgggacgacccaccgcaacgagccccagcagugggugcuccccuccuacagcggccgggacguccacaacgugcaccuggccccggcgguggcccccaccuuccccggcgagcagcuccucuucuuccgcuccaccaugcccgggugcagcggcuacccgaacauggaccuggacugccugcucccccaggaguggguccagcacuucuaccaggaggccgcccccgcgcaguccgacguggcccugcugcgguucgugaaccccgacacggggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggaccggccgccggcgcgcccuguga

SEQ ID NO: 8940 - RNA, 1623 nt, Artificial Sequence; identical to SEQ ID NO: 8917
  derived and/or modified sequence opt1 from capsid_protein_VP1__Norovirus__AGE89556

SEQ ID NO: 8941 - RNA, 1623 nt, Artificial Sequence
  derived and/or modified sequence opt1 from capsid_protein_VP1__Norovirus__AGE89559
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcuccugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaaggaggacgggagcacccggggccacaaggccaccguguacaccggcuccgcccccuucacgccgaagcuggggagcgugcaguucagcaccgacaccgagaacgacuucgagacccaccagaacacgaaguucacccccgucggcgugauccaggacgggggcaccacccaccgcaacgagccccagcagugggugcuccccuccuacagcgggcgggacguccacaacgugcaccuggccccggccguggcgcccacguuccccggcgagcagauccuguucuuccgcuccaccaugcccggcugcagcggguacccgaacauggaccucgacugccugcugccccaggaguggguccagcacuucuaccaggaggccgcccccgcccaguccgacguggcgcuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacgcuggcccccaugggcaacggcaccgggcgccggcgcgcccucuga

SEQ ID NO: 8942 - RNA, 1623 nt, Artificial Sequence
  derived and/or modified sequence opt1 from capsid_protein_VP1__Norovirus__AGE89562
augaagauggccagcaacgacgccaaccccuccgacggcagcgcggccucccuggugcccgaggucagcaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagaccaacgaccccaccaucaagcugaucgccaugcucuacacgccccugcgggcgaacaacgccggcgaggacguguucaccgugagcugccgcguccugacccggccgucccccgacuucgacuucaucuuccucgugccgcccaccguggagagccgcacgaagcccuucaccguccccauccugaccguggaggagaugaccaacucccgguuccccaucccccuggagaagcuguucacgggcccgagcggggccuucgugguccagccccagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgacccgacggaggagauccccgcgccccucggcacccccgacuucguggggaagauccagggcguccugacccagaccacgaagggggacggcagcacccggggccacaaggccaccguguacaccggguccgccccguucacgcccaagcugggcagcgugcaguucagcaccgacaccgagaacgacuucgagacccaccagaacacgaaguucacccccgucggggugauccaggacggcgggaccacccaccgcaacgagccccagcagugggugcucccguccuacagcggccgggacguccacaacgugcaccuggcccccgccguggcgcccacguuccccggcgagcagcuccucuucuuccgcuccaccaugccggggugcagcggcuaccccaacauggaccuggacugccugcucccccaggaguggguccagcacuucuaccaggaggccgcccccgcccaguccgacguggcgcugcugcgguucgugaacccggacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcgcccuguga

SEQ ID NO: 8943 - RNA, 1623 nt, Artificial Sequence
  derived and/or modified sequence opt1 from capsid_protein_VP1__Norovirus__AGE89565
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaccccggcgccccucggcacccccgacuucguggggaagauccagggcguccugacccagacgaccaagggggacggcagcacccggggccacaaggccaccguguacacgggguccgcccccuucaccccgaagcugggcagcgugcaguucagcaccgacaccgagaacgacuucgagacgcaccagaacaccaaguucacccccgucggggugauccaggacggcgggaccacgcaccgcaacgagccccagcagugggugcuccccuccuacagcggccgggacguccacaacgugcaccuggccccggccguggcgcccaccuuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacacggggcagcacgaccuggucaucccgcccaacggcuacuuccgguucgacuccugggugaaccaguucuacacccucgcccccaugggcaacgggaccggccgccggcgcgcccuguga

SEQ ID NO: 8944 - RNA, 1623 nt, Artificial Sequence; identical to SEQ ID NO: 8835
  derived and/or modified sequence opt1 from capsid_protein_VP1__Norovirus__AGE89568

SEQ ID NO: 8945 - RNA, 1623 nt, Artificial Sequence; identical to SEQ ID NO: 8835
  derived and/or modified sequence opt1 from capsid_protein_VP1__Norovirus__AGE89571

SEQ ID NO: 8946 - RNA, 1623 nt, Artificial Sequence; identical to SEQ ID NO: 8835
  derived and/or modified sequence opt1 from capsid_protein_VP1__Norovirus__AGE89574

SEQ ID NO: 8947 - RNA, 1623 nt, Artificial Sequence; identical to SEQ ID NO: 8835
  derived and/or modified sequence opt1 from capsid_protein_VP1__Norovirus__AGE89577

SEQ ID NO: 8948 - RNA, 1623 nt, Artificial Sequence; identical to SEQ ID NO: 8868
  derived and/or modified sequence opt1 from capsid_protein_VP1__Norovirus__AGE89580

SEQ ID NO: 8949 - RNA, 1623 nt, Artificial Sequence; identical to SEQ ID NO: 8835
  derived and/or modified sequence opt1 from capsid_protein_VP1__Norovirus__AGE89583

SEQ ID NO: 8950 - RNA, 1623 nt, Artificial Sequence
  derived and/or modified sequence opt1 from capsid_protein_VP1__Norovirus__AGE89586
augaagauggccagcaacgacgccaaccccuccgacggcagcgcggccaaccuggugcccgaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgaccccaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcugcugggcaccacgcagcucagccccgucaacaucugcaccuuccggggcgacgugacccacaucgccgggucccgcaacuacaccaugaaccuggccagccugaacuggaacaacuacgacccgacggaggaggugcccgcgccccucggcacccccgacuucgucgggaagauccagggcgugcugacccagaccacgaagggggacggcuccacccggggccacaaggccaccguguacaccgggagcgccccguucacgcccaagcugggcuccguccaguucagcaccgacaccgagaacgacuucgagacccaccagaacacgaaguucacccccgugggggugauccaggacggcgggaccacccaccgcaacgagccccagcaguggguccucccgagcuacuccggccgggacgugcacaacgugcaccuggcccccgccgucgcgcccacguuccccggcgagcagcuccucuucuuccgcagcaccaugccggggugcuccggcuaccccaacauggaccuggacugccugcucccccaggagugggugcagcacuucuaccaggaggccgcccccgcccagagcgacguggcgcugcugcgguucgucaacccggacaccgggcgcguccucuucgagugcaagcugcacaaguccggcuacgugaccguggcccacaccgggcagcacgaccuggugaucccgcccaacggcuacuuccgguucgacagcugggugaaccaguucuacacgcucgcccccaugggcaacgggaccggccgccggcgcgcccuguga

SEQ ID NO: 8951 - RNA, 1623 nt, Artificial Sequence; identical to SEQ ID NO: 8835
  derived and/or modified sequence opt1 from capsid_protein_VP1__Norovirus__AGE89589

SEQ ID NO: 8952 - RNA, 1623 nt, Artificial Sequence; identical to SEQ ID NO: 8835
  derived and/or modified sequence opt1 from capsid_protein_VP1__Norovirus__AGE89592

SEQ ID NO: 8953 - RNA, 1623 nt, Artificial Sequence; identical to SEQ ID NO: 8882
  derived and/or modified sequence opt1 from capsid_protein_VP1__Norovirus__AGE89595

SEQ ID NO: 8954 - RNA, 1623 nt, Artificial Sequence
  derived and/or modified sequence opt1 from capsid_protein_VP1__Norovirus__AGE89598
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccgggacguccagaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcgcccuguga

SEQ ID NO: 8955 - RNA, 1623 nt, Artificial Sequence; identical to SEQ ID NO: 8835
  derived and/or modified sequence opt1 from capsid_protein_VP1__Norovirus__AGE89601

SEQ ID NO: 8956 - RNA, 1623 nt, Artificial Sequence; identical to SEQ ID NO: 8835
  derived and/or modified sequence opt1 from capsid_protein_VP1__Norovirus__AGE89604

SEQ ID NO: 8957 - RNA, 1623 nt, Artificial Sequence; identical to SEQ ID NO: 8835
  derived and/or modified sequence opt1 from capsid_protein_VP1__Norovirus__AGE89607

SEQ ID NO: 8958 - RNA, 1623 nt, Artificial Sequence; identical to SEQ ID NO: 8835
  derived and/or modified sequence opt1 from capsid_protein_VP1__Norovirus__AGE89610

SEQ ID NO: 8959 - RNA, 1623 nt, Artificial Sequence; identical to SEQ ID NO: 8868
  derived and/or modified sequence opt1 from capsid_protein_VP1__Norovirus__AGE89613

SEQ ID NO: 8960 - RNA, 1623 nt, Artificial Sequence
  derived and/or modified sequence opt1 from capsid_protein_VP1__Norovirus__AGE89616
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccaacgccuucgucgugcagccccagaacgggcgcugcacgaccgacggcguccuccuggggaccacccagcucagccccgugaacaucugcacguuccggggcgacgugacccacaucccgggcucccgcaacuacaccaugaaccuggccagccagaacuggaacuccuacgaccccaccgaggagauccccgcgccccuggggacgccggacuucgucggcaagauccagggggugcucacccagaccacccggacgaacggcagcacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccugcccuccuacagcgggcgggacgugcacaacgugcaccucgcccccgccgucgcccccaccuucccgggcgagcagcugcuguucuuccgcuccaccaugcccgggugcagcggcuaccccaacauggaccucgacugccugcugccccaggagugggugcaguacuucuaccaggaggcggccccggcccaguccgacguggcccuccugcgguucgucaaccccgacaccggccgcgugcuguucgagugcaagcuccacaagagcggguacgugaccgucgcgcacaccggccagcacgaccuggugaucccgcccaacggguacuuccgguucgacuccugggugaaccaguucuacacccuggcccccaugggcaacgggacgggccgccgccgggcccucuga

SEQ ID NO: 8961 - RNA, 1623 nt, Artificial Sequence; identical to SEQ ID NO: 8882
  derived and/or modified sequence opt1 from capsid_protein_VP1__Norovirus__AGE89622

SEQ ID NO: 8962 - RNA, 1623 nt, Artificial Sequence
  derived and/or modified sequence opt1 from capsid_protein_VP1__Norovirus__AGE89625
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaucaaccagaacaccaaguucacccccgugggggugauccaggacggcuccacgacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggaccggccgccgccgggcccucuga

SEQ ID NO: 8963 - RNA, 1623 nt, Artificial Sequence
  derived and/or modified sequence opt1 from capsid_protein_VP1__Norovirus__AGE89628
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcgggaccacccaccgcaacgagccccagcaguggguccugcccagcuacuccggccggaacauccacaacgugcaccucgccccggccguggcccccaccuuccccggggagcagcugcuguucuuccgcagcacgaugcccggcugcuccggcuacccgaacauggaccucgacugccugcugccccaggaguggguccaguacuucuaccaggaggcggcccccgcccagagcgacguggcccuccugcgguucgugaaccccgacaccgggcgcguccuguucgagugcaagcuccacaaguccggcuacgugaccguggcgcacaccgggcagcacgaccuggucaucccgcccaacggcuacuuccgguucgacagcugggugaaccaguucuacacccuggcccccauggggaacggcacgggccgccgccgggcccucuga

SEQ ID NO: 8964 - RNA, 1623 nt, Artificial Sequence; identical to SEQ ID NO: 8835
  derived and/or modified sequence opt1 from capsid_protein_VP1__Norovirus__AGE89631

SEQ ID NO: 8965 - RNA, 1623 nt, Artificial Sequence; identical to SEQ ID NO: 8889
  derived and/or modified sequence opt1 from capsid_protein_VP1__Norovirus__AGE89634

SEQ ID NO: 8966 - RNA, 1623 nt, Artificial Sequence; identical to SEQ ID NO: 8835
  derived and/or modified sequence opt1 from capsid_protein_VP1__Norovirus__AGE89637

SEQ ID NO: 8967 - RNA, 1623 nt, Artificial Sequence; identical to SEQ ID NO: 8835
  derived and/or modified sequence opt1 from capsid_protein_VP1__Norovirus__AGE89640

SEQ ID NO: 8968 - RNA, 1623 nt, Artificial Sequence
  derived and/or modified sequence opt1 from capsid_protein_VP1__Norovirus__AGE89643
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcaguggaugcuccccuccuacagcggccgggacgugcacaacguccaccuggccccggccguggcgcccacguuccccggcgagcagcuccucuucuuccgcuccaccaugcccgggugcagcggcuacccgaacauggaccuggacugccugcucccccaggagugggugcagcacuucuaccaggaggccgcccccgcccaguccgacgucgcgcugcugcgguucgugaaccccgacaccgggcgcguccucuucgagugcaagcugcacaagagcggcuacgugaccguggcccacaccgggcagcacgaccuggugaucccgcccaacggcuacuuccgguucgacuccugggucaaccaguucuacacgcucgcccccaugggcaacgggaccggccgccggcgcgcccuguga

SEQ ID NO: 8969 - RNA, 1623 nt, Artificial Sequence; identical to SEQ ID NO: 8835
  derived and/or modified sequence opt1 from capsid_protein_VP1__Norovirus__AGE89646

SEQ ID NO: 8970 - RNA, 1623 nt, Artificial Sequence
  derived and/or modified sequence opt1 from capsid_protein_VP1__Norovirus__AGE89649
augaagauggccagcaacgacgccaaccccuccgacggcagcgcggccaaccuggugcccgaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgaccccaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcugcugggcaccacgcagcucagccccgucaacaucugcaccuuccggggcgacgugacccacaucgccgggucccgcaacuacaccaugaaccuggccagccugaacuggaacaacuacgacccgacggaggagauccccgcgccccucggcacccccgacuucguggggaagauccagggcguccugacccagaccacgaagggggacggcuccacccggggccacaaggccaccguguacaccgggagcgccccguucacgcccaagcugggcuccgugcaguucagcaccgacaccgagaacgacuucgagacccaccagaacacgaaguucacccccgucggggugauccaggacggcgggaccacccaccgcaacgagccccagcagugggugcucccgagcuacuccggccgggacguccacaacgugcaccuggcccccgccguggcgcccacguuccccggcgagcagcuccucuucuuccgcagcaccaugccggggugcuccggcuaccccaacauggaccuggacugccugcucccccaggaguggguccagcacuucuaccaggaggccgcccccgcccagagcgacguggcgcugcugcgguucgugaacccggacaccgggcgcguccucuucgagugcaagcugcacaaguccggcuacgugaccguggcccacaccgggcagcacgaccuggucaucccgcccaacggcuacuuccgguucgacagcugggugaaccaguucuacacgcucgcccccaugggcaacgggaccggccgccggcgcgcccuguga

SEQ ID NO: 8971 - RNA, 1623 nt, Artificial Sequence
  derived and/or modified sequence opt1 from capsid_protein_VP1__Norovirus__AGE89652
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucgugcucgccgggaacgccuucacggcgggcaagaucaucuucgccgccgugccgcccaacuucccgaccgaggggcugucccccagccaggucaccauguucccccacaugaucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccauccugaccguggaggagaugaccaacagccgguuccccaucccccuggagaagcuguucaccggcccguccagcgccuucgucgugcagccccagaacgggcgcugcacgaccgacggcguccugcuggggaccacccagcucucccccgugaacaucugcacguuccggggcgacgugacccacaucaccggcagccacaacuacaccaugaaccuggccacgcagaacuggaacuccuacgacccgaccgaggagauccccgcgccccuggggacccccgacuucgucggcaagauccagggggugcucacccagacgacccgcgccgacggcagcacccgggggcacaaggccaccguguacacgggcagcgccgacuucgccccgaagcugggccgcguccaguucgccaccgacaccaacaacgaccugggggccaaccagaacaccaaguucacgcccgugggcgugauccaggacgggggcaccgcgcaccggaacgagccccagcaguggguccuccccuccuacagcgggcgcaacucccacaacgugcaccuggccccggccguggcccccaccuuccccggcgagcagcuccucuucuuccggagcaccaugcccggcugcuccggguacccgaacauggaccuggacugccugcucccccaggaguggguccaguacuucuaccaggaggcggcccccgcccagagcgacguggcccugcugcgcuucgugaaccccgacacgggccggguccucuucgagugcaagcugcacaaguccggguacgugaccguggcccacaccggccagcacgaccuggucaucccgcccaacggguacuuccgcuucgacagcugggugaaccaguucuacacccucgcgcccaugggcaacggcaccgggcggcgccgcgcccuguga

SEQ ID NO: 8972 - RNA, 1623 nt, Artificial Sequence; identical to SEQ ID NO: 8835
  derived and/or modified sequence opt1 from capsid_protein_VP1__Norovirus__AGE89655

SEQ ID NO: 8973 - RNA, 1623 nt, Artificial Sequence; identical to SEQ ID NO: 8835
  derived and/or modified sequence opt1 from capsid_protein_VP1__Norovirus__AGE89658

SEQ ID NO: 8974 - RNA, 1623 nt, Artificial Sequence; identical to SEQ ID NO: 8835
  derived and/or modified sequence opt1 from capsid_protein_VP1__Norovirus__AGE89661

SEQ ID NO: 8975 - RNA, 1623 nt, Artificial Sequence
  derived and/or modified sequence opt1 from capsid_protein_VP1__Norovirus__AGE89664
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgaggacgacuucgagacccaccagaacacgaaguucacccccgucggggugauccaggacggcgggaccacccaccgcaacgagccccagcagugggugcuccccuccuacagcggccgggacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcgcccuguga

SEQ ID NO: 8976 - RNA, 1623 nt, Artificial Sequence; identical to SEQ ID NO: 8835
  derived and/or modified sequence opt1 from capsid_protein_VP1__Norovirus__AGE89667

SEQ ID NO: 8977 - RNA, 1623 nt, Artificial Sequence; identical to SEQ ID NO: 8835
  derived and/or modified sequence opt1 from capsid_protein_VP1__Norovirus__AGE89673

SEQ ID NO: 8978 - RNA, 1623 nt, Artificial Sequence
  derived and/or modified sequence opt1 from capsid_protein_VP1__Norovirus__AGE99603
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcuccaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcagaugauccucgccgggaacgccuucaccgccggcaagaucaucuucgccgccgucccgcccaacuucccgacggaggggcugucccccagccaggugaccauguucccccacaucaucguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucacggugcccguccugaccguggaggagaugaccaacucccgguuccccaucccccuggagaagcuguucaccggcccgagcuccgccuucgugguccagccccagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgacccgaccgaggagauccccgcgccccucgggacgcccgacuucgugggcaagauccaggggguccugacccagaccaccaagggcgacggguccacgcggggccacaaggccaccguguacaccggcagcgccgacuucaccccgaagcuggggagcgugcaguucggcacggacaccgacaacgacuucgagacccaccagaacacccgcuucacgcccgucggggugauccaggacggcgccaccacccaccggaacgagccccagcagugggugcuccccuccuacagcgggcgcaacguccacaacgugcaccuggccccggcgguggcccccaacuuccccggcgagcagcuccucuucuuccgguccaccaugcccggcugcagcggguacccgaacauggaccuggacugccugcucccccaggaguggguccagcacuucuaccaggaggccgcccccgcgcaguccgacguggcccugcugcgcuucgugaaccccgacacgggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcaccgggcggcgccgcgcccuguga

SEQ ID NO: 8979 - RNA, 1623 nt, Artificial Sequence
  derived and/or modified sequence opt1 from capsid_protein_VP1__Norovirus__AGI17592
augaugauggccagcaacgacgccgcgcccuccaacgacggcgccaccgggcuggugccggagaucaaccacgagacccucccccuggagcccgucgccggcgccgccaucgcggcccccgugacggggcagaacaacaucaucgacccguggauccgcaccaacuucgugcaggcccccaacggcgaguucaccgucagcccccggaacucccccggggagauccugcucaaccuggagcugggcccggaccucaaccccuaccuggcccaccugagccgcauguacaacggcuacgccgggggcguggaggugcagguccuccuggccgggaacgccuucaccgccggcaagauccuguucgccgcggugccgcccaacuuccccguggaguuccucucccccgcccagaucacgaugcugccccaccugaucgucgacgugcggacccucgagcccaucaugaucccgcugcccgacgugcgcaacaccuucuuccacuacaacaaccagcccgccaaccggaugcgccuggucgccaugcucuacacgccccugcggagcaacggguccggcgacgacguguucaccgugagcugccgcguccugacccggccgacccccgacuucgaguucaccuaccucgugccgcccuccguggagagcaagacgaagcccuucucccugcccauccugaccaucagcgagcucaccaacucccgcuuccccgcccccaucgacagccuguacaccgcgcagaacaacaaccugaacguccagugccagaacggccggugcacgcucgacggggagcugcagggcaccacccagcugcucccguccgggaucugcgccuuccgcggcaagcugaccgccgacgugcaccagagccacgacgaccgguggcacaugcagcugacgaaccucaacggcacccccuucgaccccaccgaggacgugccggcgccccuggggacccccgacuucacgggccuccuguucggggucgccucccagcgcaacguggugagcaaccccaacaccacccgggcgcacgaggccgucaucuccaccacgagcagccaguucgugccgaagcugggcuccaucaacuucgggagcaccuccgacgacuuccagcugcagcagcccaccaaguucacccccgucggcaucaagguggagagcggccacgacuucgaccagugggcccucccccgcuacuccgggcaccugacgcugaacaugaaccucgccccgcccguggcccccaacuuccccggcgagcagcugcuguucuuccggagcaacgucccgugcgccgggggcguguccgacggggugaucgacugccuccugccccaggaguggauccaguacuucuaccaggagagcgcgcccucccagagcgacgucgcccugauccgcuacgugaaccccgacaccggccggacccucuucgaggccaagcugcaccgcaccggcuacaucacgguggcgcacuccggggacuacccgcuggucgugcccagcaacggcuacuuccgguucgacuccugggugaaccaguucuacagccuggcccccauggggaccggcaacgggcgccgccggguccaguga

SEQ ID NO: 8980 - RNA, 1650 nt, Artificial Sequence
  derived and/or modified sequence opt1 from capsid_protein_VP1__Norovirus__AGI17594
augaagauggccagcaacgacgccgcgcccuccaacgacggcgccgccgggcuggugccggagaucaacagcgaggccauggcccucgagcccgucgcgggcgccgccaucgccgcgccccugaccgggcagcagaacaucaucgaccccuggaucaugaacaacuucgugcaggccccgggcggggaguucaccaucagcccccgcaacggccccggcgaggugcugcucaaccuggagcuggggcccgagaucaacccguaccucgcccaccuggcccggauguacaacggcuacgccgggggcuucgagguccagguggugcuggcggggaacgccuucacggccggcaagaucaucuucgccgccaucccgcccaacuuccccaucgacaaccucuccgcggcccaggucaccaugugcccccacgugaucguggacguccgccagcuggagcccgugaaccugcccaugcccgacgugcggaacuccuucuuccacuacaaccagggcaccgacagccgccuccggcugaucgccaugcuguacaccccgcuccgcgccaacaacuccggggacgacgucuucacggugagcugccgggugcugacccgccccucccccgacuucagcuucaacuuccuggugcccccgaccgucgaguccaagaccaagcccuucacgcuccccauccugaccaucagcgagauguccaacagccgguuccccgugccgaucgacucccugcacaccagccccaccgacaacaucgucgugcagugccagaacggccgcgugacgcucgacggggagcugaugggcaccacccagcugcuccccucccagaucugcgccuuccggggcguccugacccagcgcacgagccgggcguccgaccaggccgacaccgccgugacgccccgcgccuucgaccaccgguggcacauccagcuggacaaccucaacgggacccacuacgacccgagcgaggacauccccggcccccuggggaucccggacuuccgcggccggguguacggggucgccagccagcgcaacuccgacggcagcacccgggcgcacgaggccaagaucgacaccaccuccagccgcuucacccccaagcugggcucccucgagaucagcacggaguccgacgacuucgacgagaacaagcccacccgguucacccccguggggaucggcgucgacaacgagcgcgaguuccagcaguggagccugccggacuacuccgggcaguucacccacaacaugcaccuggcccccgccguggcgcccaacuuccccggcgagcagcuccuguucuuccgcagccaccucccguccagcgggggcuggguggacggcacgcuggacugccugcugccccaggaguggauccagcacuucuaccaggaguccgcccccagccagacccaggucgcccucgugcgguacgugaaccccgacaccgggcgcguccuguucgaggccaagcugcacaaguccggcuucaugaccaucgcccggagcggggacuccccgaucacggugccgcccaacggcuacuuccgcuucgagagcugggugaaccccuucuacacccucgcgcccauggggaccggcaacggccggcgccggauccaguga

SEQ ID NO: 8981 - RNA, 1623 nt, Artificial Sequence
  derived and/or modified sequence opt1 from capsid_protein_VP1__Norovirus__AGK36311
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcgggucauccucgccgggaacgccuucaccgccggcaagaucaucuucgccgccgugccgcccaacuucccgacggaggggcugucccccagccaggugaccauguucccccacaucaucgucgacgugcgccagcuggagcccgugcucaucccgcugcccgacguccggaacaacuucuaccacuacaaccagaccaacgacuccaccaucaagcugaucgccaugcucuacacgccccugcgcgcgaacaacgccggcgaggacguguucaccgugagcugccggguccugacccgccccuccccggacuucgacuucaucuuccucgugccgcccaccguggagagccggacgaagcccuucaccguccccauccugaccguggaggagaugaccaacucccgcuuccccaucccccuggagaagcuguucacgggccccagcuccgccuucgugguccagccgcagaacgggcggugcaccaccgacggcgugcugcuggggaccacgcagcucagccccgucaacaucugcaccuuccgcggcgacgugacccacaucgccggcucccggaacuacaccaugaaccuggccagccugaacuggaacaacuacgaccccacggaggagaucccggcgccccucgggacccccgacuucgugggcaagauccaggggguccugacccagaccacgaagggcgacggguccacccgcggccacaaggccaccguguacaccggcagcgcccccuucacgccgaagcuggggagcgugcaguucuccaccgacaccgagaacgacuucgagauccaccagaacaccaaguucacgcccgucggcgugauccaggacgggggcaccacccaccggaacgagccccagcagugggugcuccccagcuacuccgggcgcgacguccacaacgugcaccuggccccggccguggcgcccaccuuccccggcgagcagcuccucuucuuccggagcacgaugcccggcugcuccggguacccgaacauggaccuggacugccugcucccccaggaguggguccagcacuucuaccaggaggccgcccccgcccagagcgacguggcgcugcugcgcuucgugaaccccgacaccggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcacggggcggcgccgcgcccuguga

SEQ ID NO: 8982 - RNA, 1623 nt, Artificial Sequence; identical to SEQ ID NO: 8882
  derived and/or modified sequence opt1 from capsid_protein_VP1__Norovirus__AGK36314

SEQ ID NO: 8983 - RNA, 1593 nt, Artificial Sequence
  derived and/or modified sequence opt1 from capsid_protein_VP1__Norovirus__AGM33208
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcuccaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacguggacacgaccccggacaccuucgugccccaccucgggagcauccaggccaacggcaucggcuccgggaacuacgucggcgugcugagcuggaucuccccgcccagccaccccuccgggagccagguggaccuguggaagauccccaacuacggcuccagcaucaccgaggccacgcaccucgcccccuccgucuacccgcccggguucggcgaggugcugguguucuucaugagcaagaugcccggccccggggccuacaaccugcccugccuccugccgcaggaguacaucucccaccuggccagcgagcaggcgcccaccgucggcgaggccgcccuccugcacuacguggaccccgacaccgggcggaaccugggcgaguucaaggccuaccccgacggcuuccugaccugcgugccgaacggggccuccagcggcccccagcagcuccccaucaacggggucuucguguucgugagcugggucucccgcuucuaccagcugaagcccgugggcacggcgagcuccgcccgggggcgccucggccugcggcgcuga

SEQ ID NO: 8984 - RNA, 1593 nt, Artificial Sequence
  derived and/or modified sequence opt1 from capsid_protein_VP1__Norovirus__AGM33214
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcuccaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacgugaacacgaccccggacaccuucgugccccaccucgggagcauccaggccaacggcaucggcuccgggaacuacgucggcgugcugagcuggaucuccccgcccagccaccccuccgggagccagguggaccuguggaagauccccaacuacggcuccagcaucaccgaggccacgcaccucgcccccuccgucuacccgcccggguucggcgaggugcugguguucuucaugagcaagaugcccggccccggggccuacaaccugcccugccuccugccgcaggaguacaucucccaccuggccagcgagcaggcgcccaccgucggcgaggccgcccuccugcacuacguggaccccgacaccgggcggaaccugggcgaguucaaggccuaccccgacggcuuccugaccugcgugccgaacggggccuccagcggcccccagcagcuccccaucaacggggucuucguguucgugagcugggucucccgcuucuaccagcugaagcccgugggcacggcgagcuccgcccgggggcgccucggccugcggcgcuga

SEQ ID NO: 8985 - RNA, 1593 nt, Artificial Sequence; identical to SEQ ID NO: 8983
  derived and/or modified sequence opt1 from capsid_protein_VP1__Norovirus__AGM33217

SEQ ID NO: 8986 - RNA, 1593 nt, Artificial Sequence
  derived and/or modified sequence opt1 from capsid_protein_VP1__Norovirus__AGM33220
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcuccaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacguggacacgaccccggacaccuucgugccccaccucgggagcauccaggccaacggcgucggcuccgggaacuacgugggcgugcugagcuggaucuccccgcccagccaccccuccgggagccaggucgaccuguggaagauccccaacuacggcuccagcaucaccgaggccacgcaccucgcccccuccguguacccgcccggguucggcgaggugcuggucuucuucaugagcaagaugcccggccccggggccuacaaccugcccugccuccugccgcaggaguacaucucccaccuggccagcgagcaggcgcccaccgugggcgaggccgcccuccugcacuacguggaccccgacaccgggcggaaccugggcgaguucaaggccuaccccgacggcuuccugaccugcgucccgaacggggccuccagcggcccccagcagcuccccaucaacgggguguucguguucgucagcugggugucccgcuucuaccagcugaagcccgugggcacggcgagcuccgcccgggggcgccucggccugcggcgcuga

SEQ ID NO: 8987 - RNA, 1593 nt, Artificial Sequence
  derived and/or modified sequence opt1 from capsid_protein_VP1__Norovirus__AGM33226
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcuccaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacguggacacgaccccggacaucuucgugccccaccucgggagcauccaggccaacggcaucggcuccgggaacuacgucggcgugcugagcuggaucuccccgcccagccaccccuccgggagccagguggaccuguggaagauccccaacuacggcuccagcaucaccgaggccacccaccucgcccccuccgucuacccgcccggguucggcgaggugcugguguucuucaugagcaagaugcccggccccggggccuacaaccugcccugccuccugccgcaggaguacaucucccaccuggccagcgagcaggcgcccacggucggcgaggccgcccuccugcacuacguggaccccgacaccgggcggaaccugggcgaguucaaggccuaccccgacggcuuccugaccugcgugccgaacggggccuccagcggcccccagcagcuccccaucaacggggucuucguguucgugagcugggucucccgcuucuaccagcugaagcccgugggcaccgcgagcuccgcccgggggcgccucggccugcggcgcuga

SEQ ID NO: 8988 - RNA, 1593 nt, Artificial Sequence
  derived and/or modified sequence opt1 from capsid_protein_VP1__Norovirus__AGM33229
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcuccaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacguggacacgaccccggugaccuucgucccccaccucgggagcauccaggccaacggcaucggcuccgggaacuacgugggcgugcugagcuggaucuccccgcccagccaccccuccgggagccaggucgaccuguggaagauccccaacuacggcuccagcaucaccgaggccacgcaccucgcccccuccguguacccgcccggguucggcgaggugcuggucuucuucaugagcaagaugcccggccccggggccuacaaccugcccugccuccugccgcaggaguacaucucccaccuggccagcgagcaggcgcccaccgugggcgaggccgcccuccugcacuacguggaccccgacaccgggcggaaccugggcgaguucaaggccuaccccgacggcuuccugaccugcgucccgaacggggccuccagcggcccccagcagcuccccaucaacgggguguucguguucgucagcugggugucccgcuucuaccagcugaagcccgugggcacggcgagcuccgcccgggggcgccucggccugcggcgcuga

SEQ ID NO: 8989 - RNA, 1593 nt, Artificial Sequence
  derived and/or modified sequence opt1 from capsid_protein_VP1__Norovirus__AGM33232
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcuccaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacguggacacgaccccggacaccuucgugccccaccucgggagcauccaggccaacggcaucggcuccgggaacuacgucggcgugcugagcuggaucuccccgcccagccggcccuccgggagccagguggaccuguggaagauccccaacuacggcuccagcaucaccgaggccacgcaccucgcccccuccgucuacccgcccggguucggcgaggugcugguguucuucaugagcaagaugcccggccccggggccuacaaccugcccugccuccugccgcaggaguacaucucccaccuggccagcgagcaggcgcccaccgucggcgaggccgcccuccugcacuacguggaccccgacaccgggcgcaaccugggcgaguucaaggccuaccccgacggcuuccugaccugcgugccgaacggggccuccagcggcccccagcagcuccccaucaacggggucuucguguucgugagcugggucucccgguucuaccagcugaagcccgugggcacggcgagcuccgcccgcgggcggcucggccugcgccgguga

SEQ ID NO: 8990 - RNA, 1593 nt, Artificial Sequence; identical to SEQ ID NO: 8989
  derived and/or modified sequence opt1 from capsid_protein_VP1__Norovirus__AGM33235

SEQ ID NO: 8991 - RNA, 1593 nt, Artificial Sequence
  derived and/or modified sequence opt1 from capsid_protein_VP1__Norovirus__AGM33238
augaugauggccagcaaggacgccaccuccagcguggacggcgcguccggggccggccagcugguccccgaggugaacgccagcgacccgcucgccauggaccccguggccggguccagcaccgcggucgccacgaccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggccgggaacgcguucacggccggcaagaucaucgucagcugcaucccgcccggguucggcucccacaaccucaccaucgcccaggccacccuguucccccacgugaucgccgacgugcgcacccuggaccccaucgaggucccccucgaggacgugcggaacgugcuguuccacaacaacgaccgcaaccagcagacgaugcggcuggucugcaugcucuacacgccccugcgcaccggcgggggcaccggggacagcuucgugguggcgggccgggucaugaccugccccuccccggacuucaacuuccuguuccucgugccgcccaccguggagcagaagacccgccccuucacccugcccaaccugccccucagcucccugagcaacucccgggcgccccugcccaucagcuccaugggcaucagcccggacaacguccagagcgugcaguuccagaacgggcgcugcacgcucgacggccggcugguggggaccacccccgucucccugagccacguggccaagauccgcggcaccuccaacgggacggucaucaaccucaccgagcuggacggcacccccuuccaccccuucgagggcccggcccccaucggguuccccgaccugggcgggugcgacuggcacaucaacaugacccaguucggccacagcucccagacgcaguacgacguggacaccaccccggacaccuucgugccccaccucgggagcauccaggccaacggcaucggcuccgggaacuacgucggcgugcugagcuggaucuccccgcccagccaccccuccgggagccagguggaccuguggaagauccccaacuacggcuccagcaucacggaggccacccaccucgcccccuccgucuacccgcccggguucggcgaggugcugguguucuucaugagcaagaugcccggccccggggccuacaaccugcccugccuccugccgcaggaguacaucucccaccuggccagcgagcaggcccccaccgucggcgaggcggcccuccugcacuacguggaccccgacaccgggcggaaccugggcgaguucaaggccuaccccgacggcuuccucacgugcgugccgaacggggccuccagcggcccccagcagcugcccaucaacggggucuucguguucgugagcugggucucccgcuucuaccagcugaagcccgugggcaccgccagcuccgcgcgggggcgccucggccugcggcgcuga

SEQ ID NO: 8992 - RNA, 1593 nt, Artificial Sequence; identical to SEQ ID NO: 8983
  derived and/or modified sequence opt1 from capsid_protein_VP1__Norovirus__AGM33241

SEQ ID NO: 8993 - RNA, 1593 nt, Artificial Sequence; identical to SEQ ID NO: 8984
  derived and/or modified sequence opt1 from capsid_protein_VP1__Norovirus__AGM33244

SEQ ID NO: 8994 - RNA, 1626 nt, Artificial Sequence
  derived and/or modified sequence opt1 from capsid_protein_VP1__Norovirus__AGO59890
augcgcaugagcgacggcgccgcccccaaggcgaacggguccgaggccagcggccaggaccuggugccggccgccgucgagcaggccgugcccauccagcccguggcgggggccgcccucgccgcgcccgccgccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgcgauguacaccggcuggguggggaacauggaggugcagcugguccucgccggcaacgccuucacggccgggaaggugguggucgcccuggugccgcccuacuuccccaagggcagccugaccaccgcgcagaucacgugcuucccccacgugaugugcgacguccgcacccucgagcccauccagcugccccugcucgacgugcggcgcgugcuguggcacgccacccaggaccaggaggaguccaugcggcuggucugcaugcucuacaccccgcugcgcaccaacagccccggcgacgaguccuucguggugagcgggcggcugcucuccaagcccgccgccgacuucaacuucgucuaccugacgcccccgaucgagcgcaccaucuaccggaugguggaccugcccgugauccagccccgccucugcacccacgcccgguggcccgcgccggucuacggccugcugguggaccccagccuccccuccaacccccaguggcagaacgggcgcgugcacgucgacggcacccugcugggcacgaccccgaucagcggguccugggugagcugcuucgccgccgaggccgccuacaaguuccaguccggcaucggggaggucgcgaccuucacccucaucgagcaggacggcagcgccuacgugcccggggaccgggccgcgccccugggcuacccggacuucuccggccagcuggagaucgaggugcagacggagaccaccaagaccggggacaagcucaaggucacgaccuucgagaugauccugggccccaccaccaacgccgaccaggcccccuaccaggggcgcguguucgccagcgugacggccgccgcgagccuggaccucgucgacggccgggugcgcgccgugccccgguccaucuacggguuccaggacaccaucccggaguacaacgacggccugcuggucccccucgccccgcccaucggccccuuccugcccggggaggugcugcuccgcuuccggaccuacaugcgccagaucgacaccgccgacgccgcggccgaggccaucgacugcgcccugccccaggaguucgugagcugguucgccuccaacgcguucacgguccagagcgaggcccugcuccugcgguaccgcaacacccugaccggccagcuccuguucgagugcaagcuguacaacgagggguacaucgcccuguccuacagcggcuccgggccccucaccuucccgacggacggcaucuucgagguggugagcugggucccccgccuguaccagcuggccuccgugggcagccucgcgaccgggcggaugcugaagcaguga

SEQ ID NO: 8995 - RNA, 1620 nt, Artificial Sequence
  derived and/or modified sequence opt1 from capsid_protein_VP1__Norovirus__AGT17782
augaagauggccagcaacgacgccacccccuccgacggcagcuccgcgaaccuggugccggaggucaacaacgaggugauggcccucgagcccguggccggggccgccaucgcggcccccgucgccggccagcagaacgugaucgaccccuggauccgcaacaacuucgugcaggcccccgggggcgaguucaccgucagcccccggaacgcgcccggggagauccugugguccgccagccugggccccgaccucaacccguaccugucccaccugagccgcauguacaacggcuacgccggguccuucgagguccaggugauccucgccggcaacgccuucacggcggggaagaucaucuucgccgccgugccgcccaacuuccggaccgagggccugagccccucccagaucaccauguucccgcacaucaucaccgacgugcgccagcuggagcccgugcucaucccccugcccgacauccggaacaacuucuaccacuacaaccagagcaacgacccgacgaucaagcugaucgccaugcucuacacgccccugcgcgccaacaacgcgggggacgacgucuucaccguguccugccgggugcugacccgccccagccccgacuucgacuucaucuuccucgucccgcccaccguggagucccggaccaagcccuucagcgugcccguccugaccguggaggagaugaccaacucccgcuucccgaucccccuggagaagcuguucacgggccccagcuccgccuucgugguccagccccagaacggccggugcaccaccgacggggugcuccugggcaccacgcagcucagcccggugaacaucugcaccuuccgcggggacgucacccggaucggcaacagccgcgaguaccggaugaaccuggccucccugaacuggaacaacuacgaccccaccgaggagauccccgccccgcucggcacgcccgacuucgccgggaagauccagggcgugcugacccagaccacccgccacgacgggagcacgcggggccacaaggcgaccgucuacaccggguccgccggcuucacccccaagcugggcagcgugcaguucuccacggacaccgacaacgaccucgaggccaaccagaacacccgcuucacccccgugggggucauccaggacggcaacgcccaccagggggagccgcagcagugggugcugcccaacuacgccggccgggacgggcacaacgugcaccuggcgcccgccgucgcccccacguucccgggcgagcagcuccuguucuuccgcagcaccaugcccggcugcuccggguaccccaacaugaaccuggacugccuccugccccaggagugggugcagcacuucuaccaggagagcgccccggcgcaguccgacguggcccugcuccgguucgucaaccccgacaccggccgcgugcuguucgagugcaagcugcacaagagcggguacgugaccgucgcccacacgggcccccacgaccucgugaucccgcccaacggguacuuccgcuucgacuccugggugaaccaguucuacacccuggcccccaugggcaacggcgccgggcggcgccgggcgcuguga

SEQ ID NO: 8996 - RNA, 1593 nt, Artificial Sequence; identical to SEQ ID NO: 8983
  derived and/or modified sequence opt1 from capsid_protein_VP1__Norovirus__AGT17785

SEQ ID NO: 8997 - RNA, 1623 nt, Artificial Sequence
  derived and/or modified sequence opt1 from capsid_protein_VP1__Norovirus__AGT17788
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccauccugacgguggaggagaugaccaacagccgguuccccaucccccuggagaagcuguucaccggccccuccagcaccuucgugguccagccgcagaacgggcgcugcacgaccgacggcgugcuccuggggaccacccagcucucccccgucaacaucugcacguuccggggcgacgugacccacaucaccggcagccgcaacuacaccaugaaccuggccucccagaacuggaacagcuacgaccccacggaggagaucccggcgccccuggggacccccgacuucgugggcaagauccaggggguccucacccagaccacgcggaccgacggcagcacccgcgggcacaaggccaccguguacacgggcuccgccgacuucagccccaagcugggccgggugcaguucgccaccgacaccgacaacgacuucgacgccaaccagaacaccaaguucacgccggucggggugauccaggacggcgggaccacccaccgcaacgagccccagcagugggugcugcccuccuacagcggccggaacacccacaacguccaccucgcccccgccguggcgccgacguuccccggggagcagcugcuguucuuccgcuccaccaugcccggcugcagcggcuaccccaacauggaccucgacugccugcugccgcaggagugggugcagcacuucuaccaggaggccgcccccgcccaguccgacgucgcgcuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacgcuggcccccauggggaacggcaccggccgccgccgggccguguga

SEQ ID NO: 8998 - RNA, 1593 nt, Artificial Sequence; identical to SEQ ID NO: 8983
  derived and/or modified sequence opt1 from capsid_protein_VP1__Norovirus__AGT17792

SEQ ID NO: 8999 - RNA, 1623 nt, Artificial Sequence
  derived and/or modified sequence opt1 from capsid_protein_VP1__Norovirus__AGT17795
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucgugaucaaccagaacaccaaguucacccccgugggggucauccaggacggcagcacgacgccccgcaacgagccccagcagugggugcugccguccuacagcgggcggaacacccacaacgugcaccucgcccccgccgucgcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacguggcccuccugcgguucgucaacccggacaccggccgcgugcuguucgagugcaagcuccacaagagcggguacgugaccgucgcgcacaccggccagcacgaccuggugaucccgcccaacggguacuuccgguucgacuccugggugaaccaguucuacacccuggcccccaugggcaacgggacgggccgccgccgggcccucuga

SEQ ID NO: 9000 - RNA, 1617 nt, Artificial Sequence
  derived and/or modified sequence opt1 from capsid_protein_VP1__Norovirus__AGT17798
augaagauggccagcuccgacgccaaccccagcgacggcuccaccgcgaaccuggugccggaggccaacaacgaggucauggcccucgagcccguggugggggccgccaucgcggcccccgucgccggccagcagaacgugaucgaccccuggauccgcaacaacuucgugcaggcccccgggggcgaguucaccgucagcccccggaacgcgcccggggaggugcugugguccgcgccccugggcccggaccucaaccccuaccugagccaccuggcccgcauguacaacggcuacgccgggggcuucgaggugcaggucauccucgccgggaacgccuucgccgccggcaagaucaucuucgccgccgugccgcccaacuucuccacggaggggcugagcccgucccaggugaccauguucccccaccugaucgucgacgugcggcagcucgagcccgugaugaucccccugccggacauccgcaacaacuucuaccacuacaaccagagcaacgaccccaccaucaagcugaucgcgaugcucuacacgccccugcgggccaacaacgucggcgacgacguguucaccguguccugccgcguccugacccggcccagcccggacuucgacuucaucuuccucgugccgcccaccguggaguccaagaccaaccccuucagcguccccauccugacgaucgaggagaugaccaacucccgcuuccccaucccccuggagaagcuguucaccggccccagcuccgcccucguggugcagccgcagaacgggcggugcaccacggacggcguccugcucgggaccacccagcugagccccgugaacaucugcaccuuccgcggcgacgucacgcacaccaccaagacccacacguaccagaugaaccuggccgcccagaacuggaacuccuacgaccccaccgaggagaccccggcgccccucggcacccccgacuucguggggaagauccagggcgugcugacgcagaccaccaaggggaacggcagcacccgggcccacaaggccacggucuacaccgggaccguggaguucacccccaagcugggccgcauccagcuguucacggacaccgacaacgaccucgaggccaaccagaacaccaaguucaccccggugggcgucauccaggacggggaccaccagaacgagccccagcagugggugcugcccagcuacuccggccggaacaaccacaacgugcaccucgcccccgcggucgccccgacguuccccggggagcagcugcuguucuuccgcagcaccaugcccggcugcuccggguaccccaacaugaaccucgacugccugcugccgcaggagugggugcaguacuucuaccaggaggccgcccccgcgcagagcgacguggcccuccugcgguucgucaaccccgacaccggccgcgugcuguucgagugcaagcuccacaaguccggcuacgugaccgucgcccacaccgggcaccacgaccuggugaucccgcccaacggcuacuuccgguucgacagcugggugucccccuucuacacgcuggcccccauggggaacggcaccgggcgccggcgcgcccucuga

SEQ ID NO: 9001 - RNA, 1593 nt, Artificial Sequence; identical to SEQ ID NO: 8983
  derived and/or modified sequence opt1 from capsid_protein_VP1__Norovirus__AGT17803

SEQ ID NO: 9002 - RNA, 1593 nt, Artificial Sequence; identical to SEQ ID NO: 8983
  derived and/or modified sequence opt1 from capsid_protein_VP1__Norovirus__AGT17806

SEQ ID NO: 9003 - RNA, 1593 nt, Artificial Sequence; identical to SEQ ID NO: 8983
  derived and/or modified sequence opt1 from capsid_protein_VP1__Norovirus__AGT17809

SEQ ID NO: 9004 - RNA, 1623 nt, Artificial Sequence
  derived and/or modified sequence opt1 from capsid_protein_VP1__Norovirus__AGT17813
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccauccugacgguggaggagaugaccaacagccgguuccccaucccccuggagaagcuguucaccggccccuccagcaccuucgugguccagccgcagaacgggcgcugcacgaccgacggcgugcuccuggggaccacccagcucucccccgucaacaucugcacguuccggggcgacgugacccacaucgccggcagccgcaacuacaccaugaaccuggccucccagaacuggaacagcuacgaccccaccgaggagaucccggcgccccuggggacgcccgacuucgugggcaagauccaggggguccucacccagaccacccggacggacggcagcacccgcgggcacaaggccaccguguacaccggcuccgccgacuucagccccaagcugggccgggugcaguucgccacggacaccgacaacgacuucgacgccaaccagaacaccaaguucaccccggucggggugauccaggacggcgggacggcccaccgcaacgagccccagcagugggugcugcccuccuacagcggccggaacacccacaacguccaccucgcgcccgccguggccccgaccuuccccggggagcagcugcuguucuuccgcuccaccaugcccggcugcagcggcuaccccaacauggaccucgacugccugcugccgcaggagugggugcaguacuucuaccaggaggccgcgcccgcccaguccgacgucgcccuccugcgguucgugaaccccgacacggggcgcgugcuguucgagugcaagcuccacaagcccggcuacgucaccguggcccacaccgggcagcacgaccuggugaucccgcccaacggcuacuuccgguucgacagcugggucaaccaguucuacacccuggcccccauggggaacggcaccggccgccgccgggcgcucuga

SEQ ID NO: 9005 - RNA, 1623 nt, Artificial Sequence
  derived and/or modified sequence opt1 from capsid_protein_VP1__Norovirus__AGT17816
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcagcaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggagcaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcugggguccgugcaguucgccacggacaccgagaacgacuucgagacccaccagaacacccgcuucacgccggucggcgugauccaggacgggggcaccacccaccggaacgagccccagcagugggugcuccccagcuacuccgggcgcaacguccacaacgugcaccuggcccccgcgguggccccgaacuuccccggcgagcagcuccucuucuuccggagcaccaugcccggcugcuccggguaccccaacauggaccuggacugccugcucccgcaggaguggguccagcacuucuaccaggaggccgcccccgcgcagagcgacguggcccugcugcgcuucgugaaccccgacacgggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcaccgggcggcgccgcgcccuguga

SEQ ID NO: 9006 - RNA, 1623 nt, Artificial Sequence
  derived and/or modified sequence opt1 from capsid_protein_VP1__Norovirus__AGT17819
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucgccggcagccgcaacuacaccaugaaccuggccucccagaacuggaacagcuacgacccgaccgaggagauccccgcgccccuggggacgcccgacuucgucggcaagauccagggggugcucacccagaccacccggacggacggcagcacccgcgggcacaaggccaccguguacaccggcuccgccgacuucagcccgaagcugggccggguccaguucgccacggacaccgacaacgacuucgugaccaaccagaacaccaaguucacgcccgugggggucauccaggacggcgggaccacgccccgcaacgagccccagcagugggugcugccguccuacagcggccggaacacccacaacgugcaccucgcccccgccgucgcgcccaccuuccccggggagcagcugcuguucuuccgcuccaccaugccgggcugcagcggcuaccccaacauggaccucgacugccugcugccccaggagugggugcaguacuucuaccaggaggccgcccccgcccaguccgacguggcgcuccugcgguucgucaacccggacaccgggcgcgugcuguucgagugcaagcuccacaagagcggcuacgugaccgucgcccacaccgggcagcacgaccuggugaucccgcccaacggcuacuuccgguucgacuccugggugaaccaguucuacacgcuggcccccauggggaacggcaccggccgccgccgggcccucuga

SEQ ID NO: 9007 - RNA, 1623 nt, Artificial Sequence
  derived and/or modified sequence opt1 from capsid_protein_VP1__Norovirus__AGT17823
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagccccuccugaucccgcugcccgacgugcgcaacaacuucuaccacuacaaccaguccaacgaccccaccaucaagcucaucgccaugcuguacacgccccugcgggccaacaacgcgggcgacgacgucuucaccgugagcugccgcgugcucacccggccgucccccgacuucgacuucaucuuccuggucccgcccaccguggagagccgcacgaagcccuucuccgugcccauccugaccaucgaggagaugaccaacagccgguuccccaucccccucgagaagcuguucaccggcccguccagcgccuucgucgugcagccccagaacgggcgcugcacgaccgacggcgugcugcucgggaccacccagcugucccccgucaacaucugcacguuccggggcgacgugacccacaucaccggcacccacaacuacgccaugaaccuggccgcccagaacuggaacagcuacgacccgacggaggagauccccgcgccccucgggacccccgacuucgucggcaagauccagggggugcugacccagaccacgcgcgccgacggcuccacccgggcccacaaggccaccguguacaccgggagcgccgaguucgcgccgaagcugggccgcguccaguucgccacggacaccgacagcgacuucgacaccaaccagaacaccaaguucacgcccgugggcgugauccaggacgggaacaccgcccaccagaacgagccccagcaguggguccuccccuccuacagcggccggaacaaccacaacgugcaccuggccccggcgguggcccccaccuuccccggggagcagcuccuguucuuccgcuccaccaugcccggcugcagcggguacccgaacaugaaccuggacugccugcucccccaggaguggguccaguacuucuaccaggaggccgcccccgcccaguccgacguggcgcugcugcgguucgugaaccccgacacgggccgcguccucuucgagugcaagcugcacaagagcggcuacgugaccguggcccacaccgggcagcacgaccuggucaucccgcccaacggcuacuuccgguucgacuccugggugagccccuucuacacccucgcccccauggggaacggcaccgggcgccggcgcgcccuguga

SEQ ID NO: 9008 - RNA, 1593 nt, Artificial Sequence; identical to SEQ ID NO: 8983
  derived and/or modified sequence opt1 from capsid_protein_VP1__Norovirus__AGT17826

SEQ ID NO: 9009 - RNA, 1620 nt, Artificial Sequence
  derived and/or modified sequence opt1 from capsid_protein_VP1__Norovirus__AGT17830
augaagauggccagcaacgacgccacccccuccgacggcagcuccgcgaaccuggugccggaggccaacaacgaggucauggcccucgagcccguggccggggccgcgaucgccgcccccguggccggccagcagaacgucaucgaccccuggauccgcaacaacuucgugcaggcgcccgggggcgaguucaccgugagcccccggaacgcccccggggagauccugugguccgccagccugggccccgaccucaacccguaccugucccaccugagccgcauguacaacggcuacgccggguccuucgagguccaggugauccucgccggcaacgcguucacggccgggaagaucaucuucgccgccgugccgcccaacuuccggaccgagggccugagccccucccagaucaccauguucccgcacaucaucaccgacguccgccagcuggagcccgugcucaucccccugcccgacauccggaacaacuucuaccacuacaaccagagcaacgacccgacgaucaagcugaucgccaugcucuacacgccccugcgcgcgaacaacgccggggacgacguguucaccgucuccugccgggugcugacccgccccagccccgacuucgacuucaucuuccucgugccgcccaccgucgagucccggaccaagcccuucagcgugcccgugcugaccgucgaggagaugaccaacucccgcuucccgaucccccuggagaagcuguucacgggccccagcuccgccuucguggugcagccccagaacggccggugcaccaccgacgggguccuccugggcaccacgcagcucagcccggugaacaucugcaccuuccgcggggacgugacccggaucggcaacagccgcgaguaccggaugaaccuggccucccugaacuggaacaacuacgaccccaccgaggagauccccgccccgcucggcacgcccgacuucgcggggaagauccagggcguccugacccagaccacccgccacgacgggagcacgcggggccacaaggccaccguguacaccggguccgccggcuucacccccaagcugggcagcguccaguucuccacggacaccgacaacgaccucgaggccaaccagaacacccgcuucacccccgugggggugauccaggacggcaacgcccaccagggggagccgcagcaguggguccugcccaacuacgcgggccgggacgggcacaacgugcaccuggcccccgccguggcccccacguucccgggcgagcagcuccuguucuuccgcagcaccaugcccggcugcuccggguaccccaacaugaaccuggacugccuccugccccaggaguggguccagcacuucuaccaggagagcgcgccggcccaguccgacguggcccugcuccgguucgugaaccccgacaccggccgcguccuguucgagugcaagcugcacaagagcggguacgugaccguggcccacacgggcccccacgaccucgucaucccgcccaacggguacuuccgcuucgacuccugggugaaccaguucuacacccuggcccccaugggcaacggcgcggggcggcgccgggcccuguga

SEQ ID NO: 9010 - RNA, 1623 nt, Artificial Sequence
  derived and/or modified sequence opt1 from capsid_protein_VP1__Norovirus__AGT17833
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacaucgccggcucccgcaacuacaccaugaaccuggccagccagaacuggaacagcuacgaccccaccgaggagaucccggcgccccuggggacgcccgacuucgucggcaagauccagggggugcucacccagaccacccggacggacggcuccacccgcgggcacaaggccaccguguacaccggcagcgccgacuucucccccaagcugggccggguccaguucgccacggacaccgacaacgacuucgugaccaaccagaacaccaaguucacgccggugggggucauccaggacggcagcaccacgccccgcaacgagccccagcagugggugcugcccuccuacagcgggcggaacacccacaacgugcaccucgccccggccgucgcgcccaccuuccccggcgagcagcugcuguucuuccgcuccaccaugcccgggugcagcggcuacccgaacauggaccucgacugccugcugccccaggagugggugcaguacuucuaccaggaggccgcccccgcccaguccgacguggcgcuccugcgguucgucaaccccgacaccggccgcgugcuguucgagugcaagcuccacaagagcggguacgugaccgucgcccacaccggccagcacgaccuggugaucccgcccaacggguacuuccgguucgacuccugggugaaccaguucuacacgcuggcccccaugggcaacgggaccggccgccgccgggcccucuga

SEQ ID NO: 9011 - RNA, 1593 nt, Artificial Sequence; identical to SEQ ID NO: 8983
  derived and/or modified sequence opt1 from capsid_protein_VP1__Norovirus__AGT17836

SEQ ID NO: 9012 - RNA, 1620 nt, Artificial Sequence
  derived and/or modified sequence opt1 from capsid_protein_VP1__Norovirus__AGT17842
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccggccaggugaccauguucccccacaucaucgucgacgugcggcagcuggagcccgugcucaucccgcugcccgacguccgcaacaacuucuaccacuacaaccagagcaacgaccccaccaucaagcugguggccaugcucuacacgccccugcgggccaacaacgcgggcgacgacguguucaccgucuccugccgcgugcugacccggccgagccccgacuucgacuucaucuuccucgugccgcccaccaucgaguccaagaccaagagcuucuccguccccauccugacgaucgaggagaugaccaacagccgcuuccccaucccccuggagaagcuguucaccgggcccuccagcacgcucguggugcagccgcagaacggccggugcaccaccgacgggguccugcucggcaccacgcagcugucccccgugaacaucugcaccuuccgcggcgacgucacccagaucaccaacacgcacagcuacgagaugaaccuggccgcccagaacuggaacuccuacgaccccaccgaggagaucccggcgccccucgggacccccgacuucgugggcaagauccagggggugcugacccagacgaccaaggagaacggcagcacccgggcccacaaggccaccgucuacacggggagcaccggcuucacccccaagcugggccgcgugcaguucgugaccgacacggaccgggaccucgagaccaaccaggacaccaaguucaccccggucggggugauccaggacggcgacgcccaccagaacgagccccagcagugggugcugcccuccuaccuggggacgaacaaccacaacguccaccucgcccccgccguggccccgaccuuccccggcgagcagcugcuguucuuccgcagcaccaugcccgggugcuccggcuaccccaacaugaaccucgacugccugcugccgcaggagugggugcaguacuucuaccaggaggcggcccccgcccagagcgacgucgcccuccugcgguucgugaaccccgacaccggccgcgugcuguucgagugcaagcuccacaaguccggguacgucaccguggcgcacacgggccggcacgaccuggugaucccgcccaacggguacuuccgcuucgacagcugggucucccccuucuacacccuggcccccaugggcaacgggaccggccggcgccgggcccucuga

SEQ ID NO: 9013 - RNA, 1623 nt, Artificial Sequence
  derived and/or modified sequence opt1 from capsid_protein_VP1__Norovirus__AGU68328
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucgccgccggcaagaucaucuucgccgccgugccgcccaacuucccgaccgaggggcugucccccagccaggugacgauguucccccacaucaucgucgacgugcggcagcuggagcccgugcucaucccgcugcccgacguccgcaacaacuucuaccacuacaaccaguccaacgacagcaccaucaagcugaucgcgaugcucuacacgccccugcgggccaacaacgccggcgacgacguguucaccguguccugccgcguccugacccggcccagcccggacuucgacuucaucuuccucgugccgcccaccguggagucccgcaccaagcccuucagcguccccgugcugaccguggaggagaugacgaacucccgguuccccaucccccuggagaagcuguucaccggccccagcuccgccuucgucgugcagccgcagaacgggcgcugcaccaccgacggcguccugcuggggacgacccagcucagccccgugaacaucugcacccugcggggcgacgugacccacaucacgggcucccgcaacuacaccaugaaccuggccagccagaacuggaacaacuacgaccccaccgaggagaucccggcgccccucgggacccccgacuucgucggcaagauccaggggaugcugacgcagaccacccggaccgacggcagcacgcgcggguacaaggccaccguguacaccggcuccgccgacuucgcccccaagcugggccgggugcaguucgagaccgacacggaccacgacuucgaggccaaccagaacaccaaguucaccccggucggggugauccaggacggcagcaccacgcaccgcaacgagccccagcagugggugcuccccuccuacagcgggcggaacacccacaacguccaccuggcgcccgccguggccccgaccuuccccggcgagcagcuccucuucuuccgcuccaccaugcccgggugcagcggcuaccccaacauggaccuggacugccugcucccgcaggagugggugcaguacuucuaccaggaggccgcgcccgcccaguccgacgucgcccugcugcgguucgugaaccccgacacgggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacgggaccggccgccgccgggugguguga

SEQ ID NO: 9014 - RNA, 1620 nt, Artificial Sequence
  derived and/or modified sequence opt1 from capsid_protein_VP1__Norovirus__AGX85889
augaagauggccagcuccgacgccaaccccagcgacggcuccaccgcgaaccuggugccggaggccaacaacgaggucauggcccucgagcccguggugggggccgccaucgcggcccccgucgccggccagcagaacgugaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucgccgccggcaagaucaucuucgccgccgugccgcccaacuucccgacggaggggcugagccccucccaggugaccauguucccccaccugaucguggacguccggcagcucgagcccgugaugaucccgcugcccgacauccgcaacaacuucuaccacuacaaccagagcaacgaccccaccaucaagcugaucgccaugcucuacacgccccugcgggcgaacaacgugggcgacgacgucuucaccguguccugccgcgugcugacccggccgagccccgacuucgacuucaucuuccucgucccgcccaccguggaguccaagaccaaccccuucagcgugcccauccugacgaucgaggagaugaccaacucccgcuuccccaucccccuggagaagcuguucaccggcccgagcuccgcccucgucgugcagccccagaacgggcggugcaccacggacggcgugcugcucgggaccacccagcugagccccgucaacaucugcaccuuccgcggcgacgugacgcacaccaccaagacccacacguaccagaugaaccuggccgcccagaacuggaacuccuacgacccgaccgaggagauccccgcgccccucggcacccccgacuucgucgggaagauccagggcgugcugacccagacgaccaaggggaacggcagcacccgggcccacaaggccaccguguacacggggagcgccgaguucaccccgaagcugggccgcauccagcuguucaccgacaccgacaacgaccucgaggccaaccagaacacgaaguucacccccgucggcgugauccaggacggggacacccaccagaacgagccccagcagugggugcugcccuccuacagcggccggaacaaccacaacguccaccucgccccggcgguggcccccaccuuccccggggagcagcugcuguucuuccgcuccacgaugcccggcugcagcggguacccgaacaugaaccucgacugccugcugccccaggagugggugcaguacuucuaccaggaggccgcccccgcgcaguccgacgucgcccuccugcgguucgugaaccccgacaccggccgcgugcuguucgagugcaagcuccacaagagcggcuacgucaccguggcccacaccgggcaccacgaccuguucaucccgcccaacggcuacuuccgguucgacuccugggugagccccuucuacacccuggcccccauggggaacggcacggggcgccggcgcgcccucuga

SEQ ID NO: 9015 - RNA, 1620 nt, Artificial Sequence
  derived and/or modified sequence opt1 from capsid_protein_VP1__Norovirus__AGX85892
augaagauggccagcuccgacgccaaccccagcgacggcuccaccgcgaaccuggugccggaggccaacaacgaggucauggcccucgagcccguggugggggccgccaucgcggcccccgucgccggccagcagaacgugaucgaccccuggauccgcaacaacuucgugcaggcccccgggggcgaguucaccgucagcccccggaacgcgcccggggaggugcugugguccgcgccccugggcccggaccucaaccccuaccugagccaccuggcccgcauguacaacggcuacgccgggggcuucgaggugcaggucauccucgccgggaacgccuucgccgccggcaagaucaucuucgccgccgugccgcccaacuucccgacggaggggcugucccccagccaggugaccauguucccccaccugaucgucgacgugcggcagcucgagcccgugaugaucccgcugcccgacauccgcaacaacuucuaccacuacaaccaguccaacgaccccaccaucaagcugaucgcgaugcucuacacgccccugcgggccaacaacgucggcgacgacguguucacggugagcugccgcguccugacccggccgucccccgacuucgacuucaucuuccucgugccgcccaccguggagagcaagaccaaccccuucuccguccccauccugacgaucgaggagaugaccaacagccgcuuccccaucccccuggagaagcuguucaccggcccguccagcgcccucguggugcagccccagaacgggcggugcaccacggacggcguccugcucgggaccacccagcugucccccgugaacaucugcaccuuccgcggcgacgucacgcacaccaccaagacccacacguaccagaugaaccuggccgcccagaacuggaacagcuacgacccgaccgaggagauccccgcgccccucggcacccccgacuucguggggaagauccagggcgugcugacccagacgaccaaggggaacggcuccacccgggcccacaaggccaccgucuacaccgggggcguggaguucaccccgaagcugggccgcauccagcuguucaccgacaccgacaacgaccucgaggccaaccagaacacgaaguucacccccgugggggucauccaggacggcgacacccaccagaacgagccccagcagugggugcugcccagcuacagcgggcggaacaaccacaacgugcaccucgccccggcggucgcccccaccuuccccggcgagcagcugcuguucuuccgcuccacgaugcccgggugcagcggcuacccgaacaugaaccucgacugccugcugccccaggagugggugcaguacuucuaccaggaggccgcccccgcgcaguccgacguggcccuccugcgguucgucaaccccgacaccggccgcgugcuguucgagugcaagcuccacaagagcggguacgugaccgucgcccacaccggccaccacgaccuguucaucccgcccaacggguacuuccgguucgacuccugggugagccccuucuacacccuggcccccaugggcaacgggacgggccgccggcgcgcccucuga

SEQ ID NO: 9016 - RNA, 1620 nt, Artificial Sequence
  derived and/or modified sequence opt1 from capsid_protein_VP1__Norovirus__AGX85895
augaagauggccagcuccgacgccaaccccagcgacggcuccaccgcgaaccuggugccggaggccaacaacgaggucauggcccucgagcccguggugggggccgccaucgcggcccccgucgccggccagcagaacgugaucgaccccuggauccgcaacaacuucgugcaggcccccgggggcgaguucaccgucagcccccggaacgcgcccggggaggugcugugguccgcgccccugggcccggaccucaaccccuaccugagccaccuggcccgcauguacaacggcuacgccgggggcuucgaggugcaggucauccucgccgggaacgccuucgccgccggcaagaucaucuucgccgccgugccgcccaacuucccgacggaggggcugucccccagccaggugaccauguucccccaccugaucaucgacguccggcagcucgagcccgugaugaucccgcugcccgacgugcgcaacaacuucuaccacuacaaccaguccaacgaccccaccaucaagcugaucgcgaugcucuacacgccccugcgggccaacaacgucggcgacgacguguucaccgugagcugccgcguccugacccggccgucccccgacuucgacuucaucuuccucgugccgcccaccguggagagcaagaccaaccccuucuccguccccauccugacgaucgaggagaugaccaacagccgcuuccccaucccccuggagaagcuguucaccggcccguccagcgcccugguggugcagccccagaacgggcggugcaccacggacggcguccugcucgggaccacccagcugucccccgugaacaucugcaccuuccgcggcgacgucacgcacaucaccaagacccacagcuaccagaugaaccuggccgcccagaacuggaacuccuacgacccgaccgaggagauccccgcgccccucggcacgcccgacuucguggggaagauccagggcgugcugacccagaccaccaaggggaacggcagcacgcgggcccacaaggccaccgucuacaccgggagcaccgaguucacgccgaagcugggccgcauccagcucgugaccgacaccgacaacgaccuggagaccaaccagaacacgaaguucacccccgugggcgucauccaggacggggacacccaccagaacgagccccagcagugggugcugcccuccuaccucggccggaacaaccacaacgugcaccuggccccggccgucgcgcccaccuuccccggggagcagcuccucuucuuccgcagcacgaugcccggcugcuccggguacccgaacaugaaccuggacugccugcucccccaggagugggugcaguacuucuaccaggaggccgcccccgcccagagcgacguggcgcugcugcgguucgucaaccccgacaccggccgcguccucuucgagugcaagcugcacaaguccggcuacgugaccguggcccacaccgggcaccacgaccuguucaucccgcccaacggcuacuuccgguucgacagcugggugucccccuucuacacccucgcccccauggggaacggcacggggcgccggcgcgcccuguga

SEQ ID NO: 9017 - RNA, 1623 nt, Artificial Sequence
  derived and/or modified sequence opt1 from capsid_protein_VP1__Norovirus__AGX85904
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcagcaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggagcaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcugggguccauccaguucgccacggacaccgagaacgacuucgagacccaccagaacacccgcuucacgccggugggcgucauccaggacgggggcaccacccaccggaacgagccccagcagugggugcuccccagcuacuccgggcgcaacgugcacaacguccaccuggcccccgcgguggccccgaacuuccccggcgagcagcuccucuucuuccggagcaccaugcccggcugcuccggguaccccaacauggaccuggacugccugcucccgcaggagugggugcagcacuucuaccaggaggccgcccccgcgcagagcgacgucgcccugcugcgcuucgugaaccccgacacgggccggguccucuucgagugcaagcugcacaaguccggguacgugaccguggcccacaccggccagcacgaccuggugaucccgcccaacggguacuuccgcuucgacagcugggucaaccaguucuacacccucgcccccaugggcaacggcaccgggcggcgccgcgcccuguga

SEQ ID NO: 9018 - RNA, 1617 nt, Artificial Sequence
  derived and/or modified sequence opt1 from capsid_protein_VP1__Norovirus__AGX85913
augaagauggccagcuccgacgccaaccccagcgacggcuccaccgcgaaccuggugccggaggccaacaacgaggucauggcccucgagcccguggugggggccgccaucgcggcccccgucgccggccagcagaacgugaucgaccccuggauccgcaacaacuucgugcaggcccccgggggcgaguucaccgucagcccccggaacgcgcccggggaggugcugugguccgcgccccugggcccggaccucaaccccuaccugagccaccuggcccgcauguacaacggcuacgccgggggcuucgaggugcaggucauccucgccgggaacgccuucgccgccggcaagaucaucuucgccgccgugccgcccaacuucuccacggaggggcugagcccgucccaggugaccauguucccccaccugaucgucgacgugcggcagcucgagcccgugaugaucccccugccggacauccgcaacaacuucuaccacuacaaccagagcaacgaccccaccaucaagcugaucgcgaugcucuacacgccccugcgggccaacaacgucggcgacgacguguucaccguguccugccgcguccugacccggcccagcccggacuucgacuucaucuuccucgugccgcccaccguggaguccaagaccaaccccuucagcguccccauccugacgaucgaggagaugaccaacucccgcuuccccaucccccuggagaagcuguucaccggccccagcuccgcccucguggugcagccgcagaacgggcggugcaccacggacggcguccugcucgggaccacccagcugagccccgugaacaucugcaccuuccgcggcgacgucacgcacaccaccaagacccacacguaccagaugaaccuggccgcccagaacuggaacuccuacgaccccaccgaggagaucccggcgccccucggcacccccgacuucguggggaagauccagggcgugcugacccagacgaccaaggagaacgggagcacccgggcccacaaggccaccgucuacacgggcaccguggaguucacccccaagcuggggcgcauccagcuguucaccgacacggacaacgaccucgaggccaaccagaacaccaaguucaccccggugggcgucauccaggacggcgaccaccagaacgagccccagcagugggugcugcccagcuacuccgggcggaacaaccacaacgugcaccucgcccccgcggucgccccgaccuuccccggcgagcagcugcuguucuuccgcagcacgaugcccgggugcuccggcuaccccaacaugaaccucgacugccugcugccgcaggagugggugcaguacuucuaccaggaggccgcccccgcgcagagcgacguggcccuccugcgguucgucaaccccgacaccgggcgcgugcuguucgagugcaagcuccacaaguccggcuacgugaccgucgcccacaccggccaccacgaccuggugaucccgcccaacggguacuuccgguucgacagcugggugucccccuucuacacccuggcccccaugggcaacgggacgggccgccggcgcgcccucuga

SEQ ID NO: 9019 - RNA, 1623 nt, Artificial Sequence
  derived and/or modified sequence opt1 from capsid_protein_VP1__Norovirus__AGX85916
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccauccugacgguggaggagaugaccaacagccgguuccccaucccccuggagaagcuguucaccggccccuccagcaccuucgugguccagccgcagaacgggcgcugcacgaccgacggcgugcuccuggggaccacccagcucucccccgucaacaucugcacguuccggggcgacgugacccacaucaccggcagccgcaacuacaccaugaaccuggccucccagaacuggaacagcuacgaccccacggaggagaucccggcgccccuggggacccccgacuucgugggcaagauccaggggguccucacccagaccacgcggaccgacggcagcacccgcgggcacaaggccaccguguacacgggcuccgccgacuucagccccaagcugggccgggugcaguucgccaccgacaccgacaacgacuucgacaccaaccagaacacgaaguucaccccggucggggugauccaggacggcgggaccacccaccgcaacgagccccagcagugggugcugcccuccuacagcggccggaacacgcacaacguccaccucgcccccgccguggccccgaccuuccccggggagcagcugcuguucuuccgcuccaccaugcccggcagcuccggcuaccccaacauggaccucgacugccugcugccgcaggagugggugcaguacuucuaccaggaggcggcccccgcccagagcgacgucgcccuccugcgguucgugaaccccgacaccgggcgcgugcuguucgagugcaagcuccacaaguccggcuacgucaccguggcgcacacggggcagcacgaccuggugaucccgcccaacggcuacuuccgguucgacagcugggucaaccaguucuacacccuggcccccauggggaacggcaccggccgccgccgggccguguga

SEQ ID NO: 9020 - RNA, 1617 nt, Artificial Sequence; identical to SEQ ID NO: 9018
  derived and/or modified sequence opt1 from capsid_protein_VP1__Norovirus__AGX85931

SEQ ID NO: 9021 - RNA, 1617 nt, Artificial Sequence
  derived and/or modified sequence opt1 from capsid_protein_VP1__Norovirus__AGX85934
augaagauggccagcuccgacgccaaccccagcgacggcuccaccgcgaaccuggugccggaggccaacaacgaggucauggcccucgagcccguggugggggccgccaucgcggcccccgucgccggccagcagaacgugaucgaccccuggauccgcaacaacuucgugcaggcccccgggggcgaguucaccgucagcccccggaacgcgcccggggaggugcugugguccgcgccccugggcccggaccucaaccccuaccugagccaccuggcccgcauguacaacggcuacgccgggggcuucgaggugcaggucauccucgccgggaacgccuucgccgccggcaagaucaucuucgccgccgugccgcccaacuucuccacggaggggcugagcccgucccaggugaccauguucccccaccugaucgucgacgugcggcagcucgagcccgugaugaucccccugccggacauccgcaacaacuucuaccacuacaaccagagcaacgaccccaccaucaagcugaucgcgaugcucuacacgccccugcgggccaacaacgucggcgacgacguguucaccguguccugccgcguccugacccggcccagcccggacuucgacuucaucuuccucgugccgcccaccguggaguccaagaccaaccccuucagcguccccauccugacgaucgaggagaugaccaacucccgcuuccccaucccccuggagaagcuguucaccggccccagcuccgcccucguggugcagccgcagaacgggcggugcaccacggacggcguccugcucgggaccacccagcugagccccgugaacaucugcaccuuccgcggcgacgucacgcacaccaccaagacccacacguaccagaugaaccuggccgcccagaacuggaacuccuacgaccccaccgaggagaucccggcgccccucggcacccccgacuucguggggaagauccagggcgugcugacccagacgaccaaggggaacggcagcacccgggcccacaaggccaccgucuacacggggaccguggaguucacccccaagcugggccgcauccagcuguucaccgacacggacaacgaccucgaggccaaccagaacaccaaguucaccccggugggcgucauccaggacggggaccaccagaacgagccccagcagugggugcugcccagcuacuccggccggaacaaccacaacgugcaccucgcccccgcggucgccccgaccuuccccggggagcagcugcuguucuuccgcagcacgaugcccggcugcuccggguaccccaacaugaaccucgacugccugcugccgcaggagugggugcaguacuucuaccaggaggccgcccccgcgcagagcgacguggcccuccugcgguucgucaaccccgacaccggccgcgugcuguucgagugcaagcuccacaaguccggcuacgugaccgucgcccacaccgggcaccacgaccuggugaucccgcccaacggcuacuuccgguucgacagcugggugucccccuucuacacccuggcccccauggggaacggcacggggcgccggcgcgcccucuga

SEQ ID NO: 9022 - RNA, 1644 nt, Artificial Sequence
  derived and/or modified sequence opt1 from capsid_protein_VP1__Norovirus__AHI59154
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagggcaucguggugcagccccagaacggccgcugcacccuggacgggacgcuccagggcaccacccagcuggucccgacccagaucugcgccuuccgggggacgcugaucggccagaccucccgcagcuccgacagcaccgacuccgcgccccggcgccgggaccacccccuccacgugcagcugaagaaccuggacggcacccaguacgacccgacggacgagguccccgccgugcucggggccaucgacuucaagggcaccguguucggggucgccagccagcgcgacguguccggccagcaggucggggccacccgggcccacgaggugcacaucaacaccacggacccccgcuacacccccaagcugggcagcauccugaugcacagcgaguccgacgacuucgugaccggccagccggugcgguucacccccaucgggaugggcgacaacgacuggcaccagugggagcuccccgacuacagcgggcaccugacgcugaacaugaaccucgcccccgcggucgccccggccuuccccggcgagcgcauccuguucuuccgcuccauggugcccagcgccgggggcuacggcuccgggcagaucgacugccugaugccccaggagugggugcagcacuucuaccaggaggcggccccgagccaguccgccgucgcccucauccgguacgugaaccccgacaccggccgcaacaucuucgaggccaagcugcaccgggagggguucaucaccguggcgaacagcggcaacaaccccaucgucgugcccccgaacggguacuuccgcuucgaggccugggugaaccaguucuacacccugacgcccaugggcaccggccaggggcggcgccggaaccaguga

SEQ ID NO: 9023 - RNA, 1623 nt, Artificial Sequence
  derived and/or modified sequence opt1 from capsid_protein_VP1__Norovirus__AHI59157
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucaccggcucccgcaacuacaccaugaaccuggccagccagaacuggaacuccuacgacccgacggaggagauccccgcgccccuggggacccccgacuucgucggcaagauccagggggugcucacccagaccacgcggaccgacggcagcacccgcgggcacaaggccaccguguacacgggcagcgccgacuucuccccgaagcugggccggguccaguucgccaccgacaccgacaacgacuucgagaccaaccagaacacgaaguucacccccgugggggugauccaggacggcgggaccacccaccgcaacgagccccagcaguggguccugcccagcuacuccggccggaacacgcacaacgugcaccucgccccggccguggcccccaccuuccccggggagcagcugcuguucuuccgcagcaccaugcccggcugcuccggcuacccgaacauggaccucgacugccugcugccccaggaguggguccaguacuucuaccaggaggcggcccccgcccagagcgacguggcccuccugcgguucgugaaccccgacaccgggcgcguccuguucgagugcaagcuccacaaguccggcuacgugaccguggcgcacacggggcagcacgaccuggucaucccgcccaacggcuacuuccgguucgacagcugggugaaccaguucuacacccuggcccccauggggaacggcaccggccgccgccgggcccucuga

SEQ ID NO: 9024 - RNA, 1629 nt, Artificial Sequence
  derived and/or modified sequence opt1 from capsid_protein_VP1__Norovirus__AHI59159
augaagauggccagcaacgacgccgcgcccuccaccgacggcgccgccgggcuggugccggagagcaacuccgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucaaccuggagcugggccccgagcucaacccguaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacgugcccgcgccccucggcgugccggacuuccaggggcgggucuucggcgugaucucccagcgcgacaagcacaacagccccgggcacaacgagcccgcgaaccggggccacgacgccgugguccccacguacaccgcccaguacaccccgaagcugggccaggugcagaucgggaccuggcagacggacgaccugaccgugaaccagcccgucaaguucacccccgugggccucaacgacaccgagcacuucaaccaguggguggucccccgcuacgccggggcccugaaccugaacacgaaccucgcgccgagcguggcccccguguuccccggcgagcggcugcuguucuuccgcuccuacgucccccucaagggcggguacggcaacccggccaucgacugccugcugccccaggagugggugcagcacuucuaccaggaggccgcgcccagcauguccgagguggcccucguccgguacaucaaccccgacaccgggcgcgcccuguucgaggccaagcugcaccgggccggcuucaugaccgugagcuccaacaccagcgcgccgguggucgugcccgccaacggguacuuccgcuucgacuccugggugaaccaguucuacagccucgcccccaugggcacggggaacggccggcgccgcguccaguga

SEQ ID NO: 9025 - RNA, 1623 nt, Artificial Sequence
  derived and/or modified sequence opt1 from capsid_protein_VP1__Norovirus__AHK24788
augcgcaugagcgacggcgccgcccccaaggcgaacggguccgaggccagcggccaggaccuggugccgaccgccgucgagcaggccgugcccauccagcccguggccggggcgucccucgccgcccccgccgcgggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgccggcaacgcguucaccgccgggaaggugguggucgcccuggugccgcccuacuuccccaagggcucccugaccgccgcccagaucacgugcuucccccacgugaugugcgacguccgcacccucgagcccauccagcugccccugcucgacgugcggcgcgugcuguggcacgcgacccaggaccaggaggagagcaugcggcuggucugcaugcucuacaccccgcugcgcaccaacucccccggcgacgagagcuucgugguguccgggcggcugcucagcaagcccgccgccgacuucaacuucgucuaccugacgcccccgaucgagcgcaccaucuaccggaugguggaccugcccgugcuccagccccgccugugcacccacgcccgguggcccgccccggucuacggccugcucguggaccccucccugcccagcaacccccaguggcagaacgggcgcgugcacgucgacggcacccugcucggcacgaccccgguguccgggagcugggucuccugcuucgcggccgaggccgccuacgaguuccagagcggcaccggggagguggccaccuucacgcugaucgagcaggacggcuccgcguacgugcccggggaccgggccgcgccccugggcuacccggacuucagcggccagcucgagaucgagguccagaccgagaccaccaaggccggggacaagcugaaggugacgaccuucgagaugauccugggccccaccaccaacguggaccaggcccccuaccaggggcgcgucuacgccagccucacggccgccgccucccuggaccugguggacggccgggugcgcgcggucccccggagcaucuacggguuccaggaccagaucccggaguacaacgacggccuccuggugccccuggccccgcccgugggccccuuccuccccggggagcugcugcuccgcuuccggaccuacaugcgccagaucgacuccgccgacgccgccgcggaggccaucgacugcgcccugccccaggaguucaucagcugguucgccuccaacgccuucaccguccagagcgaggcgcugcuccugcgguaccgcaacacccugacgggccagcuccuguucgagugcaagcuguacuccgagggguacaucgcccugagcuacuccggcagcgggccccucaccuucccgaccgacggcuucuucgaggugguguccugggucccccgccuguaccagcuggccagcgugggcucccucgccaccgggcggacgcugaaguga

SEQ ID NO: 9026 - RNA, 1623 nt, Artificial Sequence
  derived and/or modified sequence opt1 from capsid_protein_VP1__Norovirus__AHX22018
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccggggccuucgucgugcagccccagaacggccgcugcaccacggacggggugcuccugggcaccacccagcucagccccgucaacaucugcaccuuccggggcgacgugacgcacaucaccgggucccgcaacuacaccaugaaccuggccagccagaacuggaacaacuacgacccgaccgaggagauccccgcgccccugggcacgcccgacuucguggggaagauccagggcaugcucacccagaccacccggacggacggguccacccgcggccacaaggccaccgucuacaccggcagcgccgacuucgccccgaagcuggggcgggugcaguucgagacggacaccgaccacgacuucgaggccaaccagaacaccaaguucacccccgugggcgucauccaggacgggagcacgacccaccgcaacgagccccagcagugggugcugcccuccuacagcggccggaacacccacaacgugcaccucgccccggcggucgcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacguggcccuccugcgguucgucaaccccgacaccgggcgcgugcuguucgagugcaagcuccacaagagcggcuacgugaccgucgcccacaccgggcagcacgaccuggugaucccgcccaacggcuacuuccgguucgacuccugggugaaccaguucuacacccuggcccccauggggaacggcacgggccgccgccgggucguguga

SEQ ID NO: 9027 - RNA, 1623 nt, Artificial Sequence
  derived and/or modified sequence opt1 from capsid_protein_VP1__Norovirus__AHX22021
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucacgaccgacaccgacaacgacuucgugaccaaccagaacacgaaguucacccccgugggggucauccaggacggcagcaccacgccccgcaacgagccccagcagugggugcugccguccuacagcgggcggaacacccacaacgugcaccucgcccccgccgucgcccccaccuuccccggcgagcagcugcuguucuuccgcuccaccaugccggggugcagcggcuaccccaacauggaccucgacugccugcugccccaggagugggugcaguacuucuaccaggaggccgcgcccgcccaguccgacguggcccuccugcgguucgucaacccggacaccggccgcgugcuguucgagugcaagcuccacaagagcggguacgugaccgucgcccacacgggccagcacgaccuggugaucccgcccaacggguacuuccgguucgacuccugggugaaccaguucuacacccuggcgcccaugggcaacgggaccggccgccgccgggcccucuga

SEQ ID NO: 9028 - RNA, 1623 nt, Artificial Sequence
  derived and/or modified sequence opt1 from capsid_protein_VP1__Norovirus__AHX22025
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcagacgauccucgccgggaacgccuucaccgcgggcaagaucaucuucgccgccgucccgcccaacuucccgaccgaggggcugucccccagccaggugaccauguucccccacaucaucguggacguccggcagcuggagcccgugcucaucccgcugcccgacgugcgcaacaacuucuaccacuacaaccagacgaacgaccccaccaucaagcugaucgccaugcucuacacgccccugcgggccaacaacgcgggcgacgacgucuucaccguguccugccgcgugcugacccggccgagccccgacuucgacuucaucuuccucgucccgcccaccguggagucccgcaccaagcccuucagcgugcccguccugaccguggaggagaugacgaacucccgguuccccaucccccuggagaagcuguucaccggcccgagcuccgccuucgugguccagccccagaacgggcgcugcaccaccgacggcgugcuccuggggacgacccagcucagccccgucaacaucugcaccuuccggggcgacgugacccacaucuccggcagccgcaacuacacgaugaaccuggccucccagaacuggaacagcuacgacccgaccgaggagauccccgcgccccuggggacccccgacuucgugggcaagauccaggggguccucacccagacgacccggaccgacggcagcacccgcgggcacaaggccacgguguacaccggcuccgccgacuucagcccgaagcugggccgggugcaguucgccaccgacaccgacaacgacuucgagacgaaccagaacaccaaguucacccccgucggggugauccaggacggcgggaccacgcaccgcaacgagccccagcagugggugcugcccuccuacagcggccggaacacccacaacguccaccucgccccggccguggcccccaccuuccccggggagcagcugcuguucuuccgcuccaccaugcccggcugcagcggcuacccgaacauggaccucgacugccugcugccccaggagugggugcaguacuucuaccaggaggcggcccccgcccaguccgacgucgcccuccugcgguucgugaaccccgacaccgggcgcgugcuguucgagugcaagcuccacaagagcggcuacgucacgguggcgcacaccgggcagcacgaccuggugaucccgcccaacggcuacuuccgguucgacuccugggucaaccaguucuacacccuggcccccauggggaacggcaccggccgccgccgggcccucuga

SEQ ID NO: 9029 - RNA, 1623 nt, Artificial Sequence
  derived and/or modified sequence opt1 from capsid_protein_VP1__Norovirus__AHX22028
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgggugguguga

SEQ ID NO: 9030 - RNA, 1623 nt, Artificial Sequence
  derived and/or modified sequence opt1 from capsid_protein_VP1__Norovirus__AHX22032
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcagacgauccucgccgggaacgccuucaccgcgggcaagaucaucuucgccgccgucccgcccaacuucccgaccgaggggcugucccccagccaggugaccauguucccccacaucaucguggacguccggcagcuggagcccgugcucaucccgcugcccgacgugcgcaacaacuucuaccacuacaaccagacgaacgaccccaccaucaagcugaucgccaugcucuacacgccccugcgggccaacaacgcgggcgacgacgucuucaccguguccugccgcgugcugacccggccgagccccgacuucgacuucaucuuccucgucccgcccaccguggagucccgcaccaagcccuucagcgugcccguccugaccguggaggagaugacgaacucccgguuccccaucccccuggagaagcuguucaccggcccgagcuccgccuucgugguccagccccagaacgggcgcugcaccaccgacggcgugcuccuggggacgacccagcucagccccgucaacaucugcaccuuccggggcgacgugacccacaucuccggcagccgcaacuacacgaugaaccuggccucccagaacuggaacagcuacgacccgaccgaggagauccccgcgccccuggggacccccgacuucgugggcaagauccaggggguccucacccagacgacccggaccgacggcagcacccgcgggcacaaggccacgguguacaccggcuccgccgacuucagcccgaagcugggccgggugcaguucgccaccgacaccgacaacgacuucgagacgaaccagaacaccaaguucacccccgucggggugauccaggacggcgggaccacgcaccagaacgagccccagcagugggugcugcccuccuacagcggccgcgacacccacaacguccaccucgccccggccguggcccccaccuuccccggggagcagcugcuguucuuccgguccaccaugcccggcugcagcggcuacccgaacauggaccucgacugccugcugccccaggagugggugcaguacuucuaccaggaggcggcccccgcccaguccgacgucgcccuccugcgcuucgugaaccccgacaccgggcgggugcuguucgagugcaagcuccacaagagcggcuacgucacgguggcgcacaccgggcagcacgaccuggugaucccgcccaacggcuacuuccgcuucgacuccugggucaaccaguucuacacccuggcccccauggggaacggcaccggccggcgccgcgcccucuga

SEQ ID NO: 9031 - RNA, 1623 nt, Artificial Sequence
  derived and/or modified sequence opt1 from capsid_protein_VP1__Norovirus__AHX22038
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcugcuggggaccacccagcucucccccgucaacaucugcaccuuccggggcgacgugacgcacaucaccggcagccgcaacuacaccaugaaccuggccucccugaacuggaacaacuacgacccgaccgaggagauccccgcgccccucgggacgcccgacuucgugggcaagauccaggggaugcugacccagaccacccggacggacggcagcacccgcgggcacaaggccaccgucuacaccggcagcgccgacuucgccccgaagcugggccgggugcaguucgagacggacaccgaccacgacuucgaggccaaccagaacaccaaguucacccccgugggggucauccaggacggcuccacgacccaccgcaacgagccccagcagugggugcuccccagcuacuccgggcggaacacccacaacgugcaccuggccccggcggucgcccccaccuuccccggcgagcagcuccucuucuuccgcagcacgaugcccgggugcuccggcuacccgaacauggaccuggacugccugcucccccaggagugggugcaguacuucuaccaggaggccgcccccgcgcagagcgacguggcccugcugcgguucgucaaccccgacaccggccgcguccucuucgagugcaagcugcacaaguccggguacgugaccguggcccacaccggccagcacgaccuggugaucccgcccaacggguacuuccgguucgacagcugggugaaccaguucuacacccucgcccccaugggcaacgggacgggccgccgccgggucguguga

SEQ ID NO: 9032 - RNA, 1623 nt, Artificial Sequence
  derived and/or modified sequence opt1 from capsid_protein_VP1__Norovirus__AHX22041
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccacccgcacggacggcagcacccgggggcacaaggccaccguguacaccggcagcgccgacuucgccccgaagcugggccgcgugcaguucgccacggacaccgaccacgacuucgaggccaaccagaacaccaaguucacccccgucggggugauccaggacggcgggacgacccaccggaacgagccccagcagugggugcugcccuccuacagcggccgcaacacccacaacguccaccucgcgccggccguggcccccaccuuccccggggagcagcugcuguucuuccgguccacgaugcccggcugcagcggcuacccgaacauggaccucgacugccugcugccccaggagugggugcaguacuucuaccaggaggccgcgcccgcccaguccgacgucgcccuccugcgcuucgugaaccccgacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccggcgccgcgugguguga

SEQ ID NO: 9033 - RNA, 1623 nt, Artificial Sequence
  derived and/or modified sequence opt1 from capsid_protein_VP1__Norovirus__AHX22047
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccagcgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucccgggcucccgcaacuacaccaugaaccuggccagccagaacuggaacagcuacgaccccaccgaggagauccccgcgccccuggggacgccggacuucgucggcaagauccagggggugcucacccagaccacccggacgaacggcuccacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccugcccuccuacagcgggcggaacauccacaacgugcaccucgcccccgccguggcccccaccuucccgggcgagcagcugcuguucuuccgcuccaccaugcccgggugcagcggcuaccccaacauggaccucgacugccugcugccccaggaguggguccaguacuucuaccaggaggcggccccggcccaguccgacguggcccuccugcgguucgugaaccccgacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgggcccucuga

SEQ ID NO: 9034 - RNA, 1623 nt, Artificial Sequence
  derived and/or modified sequence opt1 from capsid_protein_VP1__Norovirus__AHX22050
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucgugaccaaccagaacaccaaguucacgcccgugggggucauccaggacggcagcaccacgccccgcaacgagccccagcagugggugcugccguccuacagcgggcggaacacccacaacgugcaccucgcccccgccgucgcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacguggcccuccugcgguucgucaacccggacaccggccgcgugcuguucgagugcaagcuccacaagagcggguacgugaccgucgcgcacaccggccagcacgaccuggugaucccgcccaacggguacuuccgguucgacuccugggugaaccaguucuacacgcuggcccccaugggcaacgggaccggccgccgccgggcccucuga

SEQ ID NO: 9035 - RNA, 1623 nt, Artificial Sequence
  derived and/or modified sequence opt1 from capsid_protein_VP1__Norovirus__AHX22054
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugauccacaucuccggcagccgcaacuacaccaugaaccuggccagccagaacuggaacuccuacgaccccaccgaggagaucccggcgccccuggggacccccgacuucgucggcaagauccagggggugcucacgcagaccacccggaccgacggcagcacgcgcgggcacaaggccaccguguacaccggcuccgccgacuucagccccaagcugggccggguccaguucgccaccgacacggacaacgacuucgugaccaaccagaacaccaaguucaccccggugggggucauccaggacggcuccacgacgccccgcaacgagccccagcagugggugcugcccagcuacuccgggcggaacacccacaacgugcaccucgccccggccgucgcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacguggcccuccugcgguucgucaaccccgacaccggccgcgugcuguucgagugcaagcuccacaaguccggguacgugaccgucgcgcacaccggccagcacgaccuggugaucccgcccaacggguacuuccgguucgacagcugggugaaccaguucuacacccuggcccccaugggcaacgggacgggccgccgccgggcccucuga

SEQ ID NO: 9036 - RNA, 1647 nt, Artificial Sequence
  derived and/or modified sequence opt1 from capsid_protein_VP1__Norovirus__AIA96988
augaagauggccagcaacgacgccgcgcccuccaacgacggcgccgccgggcuggugccggagaucagcaacgaggccauggcccucgaccccgucgcgggcgccgccaucgccgcgccccugaccgggcagcagaacaucaucgaccccuggaucaugaacaacuucgugcaggccccgggcggggaguucaccgugagcccccgcaacucccccggcgagauccugcucaaccuggagcugggccccgagaucaacccguaccucgcccaccuggcccggauguacaacggguacgccggcggguucgagguccagguggugcuggcgggcaacgccuucacggccgggaaggucaucuucgccgccaucccgcccaacuuccccaccgacaaccucuccgcggcccagaucaccaugugcccccacgugaucguggacguccgccagcuggagcccaucaaccugcccaugcccgacgugcggaacaacuucuuccacuacaaccagggcagcgacucccgccuccggcugaucgccaugcuguacaccccgcuccgcgccaacaacagcggcgacgacguguucacggucuccugccgggugcugacccgccccagccccgacuucuccuucaacuuccuggugcccccgaccgucgagagcaagaccaagcccuucacgcuccccauccugaccaucuccgagaugagcaacucccgguuccccgugccgaucgacagccugcacaccucccccaccgacaacaucgugguccagugccagaacgggcgcgugacgcucgacggcgagcugauggggaccacccagcugcuccccagccagaucugcgccuuccggggcgugcugacccgcuccacgagccgggcgagcgaccacgccgacaccgccacgccccgccuguucaacuacuacuggcacauccagcucgacaaccugaacggcaccccguacgaccccgccgaggacauccccgccccgcuggggacccccgacuuccggggcaaggucuucgggguggcgucccagcgcaaccccgacagcaccacccgggcccacgaggccaagguggacaccacguccggccgcuucacccccaagcucgggagccuggagauguccaccgagagcgacgacuucgaccagaaccagccgacccgguucacgcccgucggcaucggcguggacaacgaggccgacuuccagcaguggacccugcccgacuacuccgggcaguucacccacaacaugaaccucgcgcccgccgucgccccgaacuuccccggcgagcagcugcuguucuuccgcagccagcuccccuccagcgggggccgguccaacgggauccuggacugccuggugccccaggagugggugcagcacuucuaccaggagagcgccccggcccagacccaggucgcgcucgugcgcuacgugaaccccgacacgggccgcguccuguucgaggccaagcugcacaagcucggcuacaugaccaucgccaaguccggggacagccccaucaccgugcccccgaacggcuacuuccgguucgaguccugggugaaccccuucuacacccuggcccccauggggacgggcaacgggcgccggcgcauccaguga

SEQ ID NO: 9037 - RNA, 1623 nt, Artificial Sequence
  derived and/or modified sequence opt1 from capsid_protein_VP1__Norovirus__AII02569
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccgggacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcuguacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcgcccuguga

SEQ ID NO: 9038 - RNA, 1623 nt, Artificial Sequence; identical to SEQ ID NO: 8835
  derived and/or modified sequence opt1 from capsid_protein_VP1__Norovirus__AII02572

SEQ ID NO: 9039 - RNA, 1623 nt, Artificial Sequence; identical to SEQ ID NO: 8835
  derived and/or modified sequence opt1 from capsid_protein_VP1__Norovirus__AII02575

SEQ ID NO: 9040 - RNA, 1623 nt, Artificial Sequence; identical to SEQ ID NO: 8878
  derived and/or modified sequence opt1 from capsid_protein_VP1__Norovirus__AII02578

SEQ ID NO: 9041 - RNA, 1647 nt, Artificial Sequence
  derived and/or modified sequence opt1 from capsid_protein_VP1__Norovirus__AII02581
augaagauggccagcaacgacgccgcgcccuccaacgacggcgccgccgggcuggugccggagaucaacagcgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugcugcucgcgggcaacgccuucacggccgggaagaucaucuucgccgccaucccgcccaacuuccccaucgacaaccuguccgcggcccagaucaccaugugcccccacgugaucguggacgugcgccagcuggagcccgucaaccuccccaugcccgacgugcggaacaacuucuuccacuacaaccagggcagcgacucccgccugcggcugaucgccaugcucuacaccccgcugcgcgccaacaacagcggcgacgacguguucaccgucuccugccgggugcugacgcgccccagccccgacuucuccuucaacuuccucgugcccccgaccgucgagagcaagaccaagcccuucucccugcccauccugaccaucagcgagauguccaacagccgguuccccgugccgaucgacucccuccacacgagccccaccgagaacaucgugguccagugccagaacgggcgcgugacccuggacggcgagcugauggggaccacgcagcuccugcccucccagaucugcgccuuccggggcaugcugacccgcagcaccagccgggcguccgaccaggccgacaccgccacgccccgccucuucaacuacuacuggcacauccagcuggacaaccugaacggcaccccguacgaccccgccgaggacauccccgggccgcucggcacccccgacuuccgggggaagguguucggcgucgccagccagcgcaaccccgacgcgaccacgcgggcccacgaggccaagaucgacaccaccuccgggcgcuucacccccaagcugggcagccuggagaucuccacggagagcggcgacuucgaccagaaccagccgacccgguucacccccguggggaucggcguggaccacgaggccgacuuccagcaguggacccuccccgacuacgcggggcaguucacgcacaacaugaaccuggcccccgccgucgccccgaacuuccccggcgagcagcuccuguucuuccgcucccagcugcccagcuccgggggccggagcaacggcauccuggacugccucgugccccaggaguggguccagcacuucuaccaggaguccgccccgagccagacccagguggcgcuggugcgcuacgucaaccccgacaccgggcgcgugcuguucgaggccaagcuccacaagcugggcuucaugaccaucgccaaguccggggacagccccaucacggugcccccgaacggcuacuuccgguucgaguccugggucaaccccuucuacacccuggcccccauggggaccggcaacggccgccggcgcauccaguga

SEQ ID NO: 9042 - RNA, 1623 nt, Artificial Sequence
  derived and/or modified sequence opt1 from capsid_protein_VP1__Norovirus__AII02584
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagaccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcugcuggggaccacgcagcucucccccgucaacaucugcaccuuccggggcgacgugacccacaucgccggcagccgcaacuacaccaugaaccuggccucccugaacuggaacaacuacgaccccacggaggagaucccggcgccccucgggacccccgacuucgugggcaagauccaggggguccugacccagaccacgaagggcgacgggagcacccggggccacaaggccaccguguacaccggcuccgcccccuucacgccgaagcuggggagcgugcaguucagcaccgacaccgagaacgacuucgagacccaccagaacacgaaguucacccccgucggcgugauccaggacgggggcaccacccaccgcaacgagccccagcagugggugcuccccuccuacagcgggcggaacguccacaacgugcaccuggccccggccguggcgcccacguuccccggcgagcagcuccucuucuuccgcuccaccaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacgcucgcccccaugggcaacggcaccgggcgccggcgcgcccuguga

SEQ ID NO: 9043 - RNA, 1623 nt, Artificial Sequence; identical to SEQ ID NO: 8835
  derived and/or modified sequence opt1 from capsid_protein_VP1__Norovirus__AII02590

SEQ ID NO: 9044 - RNA, 1623 nt, Artificial Sequence; identical to SEQ ID NO: 8882
  derived and/or modified sequence opt1 from capsid_protein_VP1__Norovirus__AII02593

SEQ ID NO: 9045 - RNA, 1623 nt, Artificial Sequence; identical to SEQ ID NO: 8835
  derived and/or modified sequence opt1 from capsid_protein_VP1__Norovirus__AII02596

SEQ ID NO: 9046 - RNA, 1623 nt, Artificial Sequence
  derived and/or modified sequence opt1 from capsid_protein_VP1__Norovirus__AII02599
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacaucacccacaucgccgggagccgcgacuacaccaugaaccuggccucccugaacuggaacaacuacgaccccacggaggagaucccggcgccccucggcacccccgacuucguggggaagauccagggcgugcugacccagaccacgaagcgggacgggagcacccgcggccacaaggccaccgucuacaccggcuccgcccccuucacgccgaagcuggggagcgugcgguucagcaccgacaccgagaacgacuucgagacccaccagaacacgaaguucacccccgugggcgucauccaggacggguccaccacccaccgcaacgagccccagcagugggugcuccccagcuacuccggccgggacgugcacaacguccaccuggccccggccguggcgcccacguuccccggggagcagcuccucuucuuccgcagcaccaugcccggcugcuccggcuacccgaacauggaccuggacugccugcucccccaggagugggugcagcacuucuaccaggaggccgcccccgcccagagcgacgucgcgcugcugcgguucgugaaccccgacaccgggcgcguccucuucgagugcaagcugcacaaguccggcuacgugaccguggcccacaccgggcagcacgaccuggugaucccgcccaacggcuacuuccgguucgacagcugggucaaccaguucuacacgcucgcccccauggggaacggcaccggccgccgccgggcccuguga

SEQ ID NO: 9047 - RNA, 1623 nt, Artificial Sequence; identical to SEQ ID NO: 8882
  derived and/or modified sequence opt1 from capsid_protein_VP1__Norovirus__AII02602

SEQ ID NO: 9048 - RNA, 1608 nt, Artificial Sequence
  derived and/or modified sequence opt1 from capsid_protein_VP1__Norovirus__AII02605
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggaggugcuccugaaccuggagcucggccccgagcugaacccguaccuggcccaccucucccgcauguacaacggcuacgccgggggcgucgagguccaggugcugcuggccgggaacgccuucaccgccggcaagcucguguucgcggccgugccgccccacuucccccuggagaacaucagccccgggcagaucaccauguucccccacgugaucaucgacguccggacccuggagcccgugcuccugccccugccggacgugcgcaacaacuucuuccacuacaaccagcagaacgagccccggaugcgccucgucgccaugcuguacacgccccugcgguccaacggcagcggcgacgacguguucaccguguccugccgcguccucacccggcccagcccggacuucgacuucaacuaccuggugccgcccaccguggaguccaagacgaagcccuucacccugcccauccucaccaucggggagcugaccaacagccgcuuccccguccccaucgacgagcuguacacgucccccaacgagagccucguggugcagccgcagaacggccggugcgcccuggacggggagcugcagggcaccacccagcuccugcccaccgccaucugcuccuuccgcggccggaucaaccagaaggucagcggggagaaccacguguggaacaugcaggucacgaacaucaacggcacccccuucgacccgaccgaggacgugcccgcgccccuggggacccccgacuucuccggcaagcuguucggggugcucagccagcgcgaccacgacaacgccugccggucccacgacgccgucaucgccacgaacagcgccaaguucaccccgaagcugggcgcgauccagaucggcaccugggagcaggacgacgugcacaucaaccagcccaccaaguucacgcccgugggccucuucgagagcgagggguucaaccaguggacccugcccaacuacuccggggcccugacccucaacaugggccuggccccgcccgucgcccccaccuuccccggggagcagauccuguucuuccgcagccacaucccgcucaagggcggcguggccgaccccgugaucgacugccugcugccccaggaguggauccagcaccucuaccaggaguccgcgcccagccagacggacgucgcccugauccgguucaccaacccggacaccgggcgcgugcuguucgaggccaagcuccaccgguccggcuacaucaccguggccaacacggggagccgccccaucgucgugcccgcgaacggcuacuuccgguucgacuccugggugaaccaguucuacagccuggcccccauggggaccggcaacggccgccgccggguccaguga

SEQ ID NO: 9049 - RNA, 1647 nt, Artificial Sequence
  derived and/or modified sequence opt1 from capsid_protein_VP1__Norovirus__AII02608
augaagauggccagcaacgacgccgcgcccuccaacgacggcgccgccgggcuggugccggagaucaacagcgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucuccgcggcccagaucaccaugugcccccacgugaucguggacguccgccagcuggagcccgugaaccugcccaugcccgacgugcggaacaacuucuuccacuacaaccagggcagcgacucccgccuccggcugaucgccaugcuguacaccccgcuccgcgccaacaacagcggcgacgacgucuucaccguguccugccgggugcugacgcgccccagccccgacuucuccuucaacuuccuggugcccccgaccguggagagcaagaccaagcccuucucccuccccauccugaccaucagcgagauguccaacagccgguuccccgugccgaucgacucccugcacacgagccccaccgagaacaucgucgugcagugccagaacgggcgcgugacccucgacggcgagcugauggggaccacgcagcugcuccccucccagaucugcgccuuccggggcaugcugacccgcagcaccagccgggcguccgaccaggccgacaccgccacgccccgccuguucaacuacuacuggcacauccagcucgacaaccugaacggcaccccguacgaccccgccgaggacauccccgggccgcugggcacccccgacuuccgggggaaggucuucggcguggccagccagcgcaaccccgacgcgaccacgcgggcccacgaggccaagaucgacaccaccuccgggcgcuucacccccaagcucggcagccuggagaucuccacggagagcggcgacuucgaccagaaccagccgacccgguucacccccguggggaucggcgucgaccacgaggccgaccugcagcaguggacccuccccgacuacgcggggcaguucacgcacaacaugaaccuggcccccgccguggccccgaacuuccccggcgagcagcuccuguucuuccgcucccagcugcccagcuccgggggccggagcaacggcauccuggacugccucgucccccaggagugggugcagcacuucuaccaggaguccgccccgagccagacccagguggcgcugguccgcuacgugaaccccgacaccgggcgcgugcuguucgaggccaagcuccacaagcugggcuucaugaccaucgccaaguccggggacagccccaucacggugcccccgaacggcuacuuccgguucgaguccugggucaaccccuucuacacccuggcccccauggggaccggcaacggccgccggcgcauccaguga

SEQ ID NO: 9050 - RNA, 1623 nt, Artificial Sequence; identical to SEQ ID NO: 8889
  derived and/or modified sequence opt1 from capsid_protein_VP1__Norovirus__AII02614

SEQ ID NO: 9051 - RNA, 1653 nt, Artificial Sequence
  derived and/or modified sequence opt1 from capsid_protein_VP1__Norovirus__AII02623
augaagauggccagcaacgacgccacccccuccaacgacggcgcggccaaccuggugccggaggccaacaacgaggucauggcccucgagcccguggugggggccagcaucgcggcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgccggcgggaugcagguccagguggugcuggcgggcaacgccuucacggccgggaagaucaucuucgccgccgugccgccccacuuccccguggacaacaucuccgcggcccagaucaccaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcccccgacuucgaguucaccuuccuggugccgcccaccgucgagagcaagacgaagcccuucacccuccccauccugacccugggggagcucuccaacagccgguucccggcggccaucgacaugcuguacaccgaccccaacgaguccaucguggugcagccccagaacggccgcugcacgcuggacggcacccuccaggggaccacccagcugguccccacgcagaucugcgccuuccggggcacccugaucagccagaccgcccgcgccgcggacuccaccgacuucccgcagcgggcccgcaaccacccccuccacgugcaggucaagaaccuggacgggacgcaguacgaccccaccgacgacaucccggccgugcugggcgccaucgacuucaagggcaccguguucggggucgccagccagcgggacguguccggcacccaggagcaggggcacuacgcgacgcgcgcccacgaggcccacaucgacaccaccgaccccaaguacgcccccaagcucggcaccauccugaucaagagcgaguccacggacuucaacaccaaccagcccauccgguucaccccgguggggaugggcgacaacaacuggcgccagugggagcugcccgacuacagcggcagccucacccugaacaugaaccuggcgcccgccgucucccccagcuucccgggggagcggauccucuucuuccgcuccaucgugcccagcgccggcggguacggcuccggguacaucgacugccugaucccccaggagugggugcagcacuucuaccaggaggccgcccccagccaguccgcggucgcccuggugcgcuacgugaacccggacacgggccggaacaucuucgaggccaagcuccaccgcgagggcuuccugaccgucgccaacagcgggaacaaccccaucguggugccgcccaacggcuacuuccgguucgaggccugggucaaccaguucuacacccuggcgcccaugggguccggccaggggcgccggcgcgcccaguga

SEQ ID NO: 9052 - RNA, 1623 nt, Artificial Sequence; identical to SEQ ID NO: 8835
  derived and/or modified sequence opt1 from capsid_protein_VP1__Norovirus__AII02626

SEQ ID NO: 9053 - RNA, 1647 nt, Artificial Sequence
  derived and/or modified sequence opt1 from capsid_protein_VP1__Norovirus__AII02629
augaagauggccagcaacgacgccgcgcccuccaacgacggcgccgccgggcuggugccggagaucaacagcgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucuccgcggcccagaucaccaugugcccccacgugaucguggacguccgccagcuggagcccgugaaccugcccaugcccgacgugcggaacaacuucuuccacuacaaccagggcagcgacucccgccuccggcugaucgccaugcuguacaccccgcuccgcgccaacaacagcggcgacgacgucuucaccguguccugccgggugcugacgcgccccagccccgacuucuccuucaacuuccuggugcccccgaccguggagagcaagaccaagcccuucucccuccccauccugaccaucagcgagauguccaacagccgguuccccgugccgaucgacucccugcacacgagccccaccgagaacaucgucgugcagugccagaacgggcgcgugacccucgacggcgagcugauggggaccacgcagcugcuccccucccagaucugcgccuuccggggcaugcugacccgcagcaccagccgggcguccgaccaggccgacaccgccacgccccgccuguucaacuacuacuggcacauccagcucgacaaccugaacggcaccccguacgaccccgccgaggacauccccgggccgcugggcacccccgacuuccgggggaaggucuucggcguggccagccagcgcaaccccgacgcgaccacgcgggcccacgaggccaagaucgacaccaccuccgggcgcuucacccccaagcucggcagccuggagaucuccacggagagcggcgacuucgaccagaaccagccgacccgguucacccccguggggaucggcgucgaccacgaggccgacuuccagcaguggacccugcccgacuacgcggggcaguucacgcacaacaugaaccucgcccccgccguggccccgaacuuccccggcgagcagcugcuguucuuccgcucccagcuccccagcuccgggggccggagcaacggcauccuggacugccuggucccccaggagugggugcagcacuucuaccaggaguccgccccgagccagacccagguggcgcucguccgcuacgugaaccccgacaccgggcgcgugcuguucgaggccaagcugcacaagcucggcuucaugaccaucgccaaguccggggacagccccaucacggugcccccgaacggcuacuuccgguucgaguccugggucaaccccuucuacacccuggcccccauggggaccggcaacggccgccggcgcauccaguga

SEQ ID NO: 9054 - RNA, 1623 nt, Artificial Sequence; identical to SEQ ID NO: 8885
  derived and/or modified sequence opt1 from capsid_protein_VP1__Norovirus__AII02632

SEQ ID NO: 9055 - RNA, 1623 nt, Artificial Sequence; identical to SEQ ID NO: 8835
  derived and/or modified sequence opt1 from capsid_protein_VP1__Norovirus__AII02635

SEQ ID NO: 9056 - RNA, 1608 nt, Artificial Sequence; identical to SEQ ID NO: 9048
  derived and/or modified sequence opt1 from capsid_protein_VP1__Norovirus__AII02638

SEQ ID NO: 9057 - RNA, 1623 nt, Artificial Sequence; identical to SEQ ID NO: 8835
  derived and/or modified sequence opt1 from capsid_protein_VP1__Norovirus__AII02641

SEQ ID NO: 9058 - RNA, 1647 nt, Artificial Sequence; identical to SEQ ID NO: 9053
  derived and/or modified sequence opt1 from capsid_protein_VP1__Norovirus__AII02644

SEQ ID NO: 9059 - RNA, 1623 nt, Artificial Sequence; identical to SEQ ID NO: 8870
  derived and/or modified sequence opt1 from capsid_protein_VP1__Norovirus__AII02647

SEQ ID NO: 9060 - RNA, 1623 nt, Artificial Sequence; identical to SEQ ID NO: 8882
  derived and/or modified sequence opt1 from capsid_protein_VP1__Norovirus__AII02650

SEQ ID NO: 9061 - RNA, 1623 nt, Artificial Sequence
  derived and/or modified sequence opt1 from capsid_protein_VP1__Norovirus__AII02653
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccgggacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacgcggcccugcugcgguucgugaaccccgacaccgggcgcguccucuucgagugcaagcugcacaagagcggcuacgugaccguggcccacaccgggcagcacgaccuggugaucccgcccaacggcuacuuccgguucgacuccugggucaaccaguucuacacgcucgcccccaugggcaacgggaccggccgccggcgcgcccuguga

SEQ ID NO: 9062 - RNA, 1647 nt, Artificial Sequence; identical to SEQ ID NO: 9053
  derived and/or modified sequence opt1 from capsid_protein_VP1__Norovirus__AII02656

SEQ ID NO: 9063 - RNA, 1623 nt, Artificial Sequence; identical to SEQ ID NO: 8835
  derived and/or modified sequence opt1 from capsid_protein_VP1__Norovirus__AII02659

SEQ ID NO: 9064 - RNA, 1647 nt, Artificial Sequence; identical to SEQ ID NO: 9053
  derived and/or modified sequence opt1 from capsid_protein_VP1__Norovirus__AII02662

SEQ ID NO: 9065 - RNA, 1623 nt, Artificial Sequence; identical to SEQ ID NO: 8835
  derived and/or modified sequence opt1 from capsid_protein_VP1__Norovirus__AII02665

SEQ ID NO: 9066 - RNA, 1623 nt, Artificial Sequence; identical to SEQ ID NO: 8835
  derived and/or modified sequence opt1 from capsid_protein_VP1__Norovirus__AII02668

SEQ ID NO: 9067 - RNA, 1623 nt, Artificial Sequence; identical to SEQ ID NO: 8835
  derived and/or modified sequence opt1 from capsid_protein_VP1__Norovirus__AII02671

SEQ ID NO: 9068 - RNA, 1623 nt, Artificial Sequence
  derived and/or modified sequence opt1 from capsid_protein_VP1__Norovirus__AII02674
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucaucgugcagccgcagaacggccgcugcacgaccgacgggguccugcugggcaccacccagcucucccccgugaacaucugcacguuccggggcgacgucacccacaucgccgggagccgcaacuacaccaugaaccuggccucccugaacuggaacaacuacgaccccaccgaggagaucccggcgccccucggcacgcccgacuucguggggaagauccagggcgugcugacccagaccaccaagggggacggcagcacgcggggccacaaggccaccgucuacaccggguccgcccccuucaccccgaagcugggcagcgugcaguucagcacggacaccgagaacgacuucgaggcccaccagaacaccaaguucacccccgugggggucauccaggacggcgggacgacccaccgcaacgagccccagcagugggugcuccccuccuacagcggccgggacgugcacaacguccaccuggccccggcgguggcccccaccuuccccggcgagcagcuccucuucuuccgcuccaccaugcccgggugcagcggcuacccgaacauggaccuggacugccugcucccccaggagugggugcagcacuucuaccaggaggccgcccccgcgcaguccgacgucgcccugcugcgguucgugaaccccgacacggggcgcguccucuucgagugcaagcugcacaagagcggcuacgugaccguggcccacaccgggcagcacgaccuggugaucccgcccaacggcuacuuccgguucgacuccugggucaaccaguucuacacccucgcccccaugggcaacgggaccggccgccggcgcgcccuguga

SEQ ID NO: 9069 - RNA, 1623 nt, Artificial Sequence; identical to SEQ ID NO: 8878
  derived and/or modified sequence opt1 from capsid_protein_VP1__Norovirus__AII02677

SEQ ID NO: 9070 - RNA, 1623 nt, Artificial Sequence
  derived and/or modified sequence opt1 from capsid_protein_VP1__Norovirus__AII02680
augaagauggccagcaacgacgccaaccccuccgacggcagcgcggccaaccuggugcccgaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaucaacgaccccaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcaccaagcccuucacgguccccauccugaccguggaggagaugaccaacagccgguuccccaucccccuggagaagcuguucaccggcccguccggggccuucgugguccagccccagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgacccgaccgaggagauccccgcgccccucggcacgcccgacuucguggggaagauccagggcguccugacccagaccaccaagggggacggcuccacgcggggccacaaggccaccguguacaccgggagcgccccguucacccccaagcugggcuccgugcaguucagcacggacaccgagaacgacuucgagacccaccagaacaccaaguucacgcccgucggggugauccaggacggcagcaccacccaccgcaacgagccccagcagugggugcucccguccuacagcgggcgggacauccacaacguccaccuggcccccgccguggcgcccaccuuccccggcgagcagcuccucuucuuccgcuccacgaugccgggcugcagcggguaccccaacauggaccuggacugccugcucccccaggagugggugcagcacuucuaccaggaggccgcccccgcccaguccgacgucgcgcugcugcgguucgugaacccggacaccggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacggcacggggcgccggcgcgcccuguga

SEQ ID NO: 9071 - RNA, 1623 nt, Artificial Sequence; identical to SEQ ID NO: 8835
  derived and/or modified sequence opt1 from capsid_protein_VP1__Norovirus__AII02683

SEQ ID NO: 9072 - RNA, 1623 nt, Artificial Sequence; identical to SEQ ID NO: 8835
  derived and/or modified sequence opt1 from capsid_protein_VP1__Norovirus__AII02689

SEQ ID NO: 9073 - RNA, 1623 nt, Artificial Sequence; identical to SEQ ID NO: 8922
  derived and/or modified sequence opt1 from capsid_protein_VP1__Norovirus__AII02692

SEQ ID NO: 9074 - RNA, 1623 nt, Artificial Sequence; identical to SEQ ID NO: 8885
  derived and/or modified sequence opt1 from capsid_protein_VP1__Norovirus__AII02695

SEQ ID NO: 9075 - RNA, 1623 nt, Artificial Sequence; identical to SEQ ID NO: 8835
  derived and/or modified sequence opt1 from capsid_protein_VP1__Norovirus__AII02698

SEQ ID NO: 9076 - RNA, 1623 nt, Artificial Sequence; identical to SEQ ID NO: 8835
  derived and/or modified sequence opt1 from capsid_protein_VP1__Norovirus__AII02701

SEQ ID NO: 9077 - RNA, 1623 nt, Artificial Sequence; identical to SEQ ID NO: 8835
  derived and/or modified sequence opt1 from capsid_protein_VP1__Norovirus__AII02707

SEQ ID NO: 9078 - RNA, 1623 nt, Artificial Sequence; identical to SEQ ID NO: 8889
  derived and/or modified sequence opt1 from capsid_protein_VP1__Norovirus__AII02710

SEQ ID NO: 9079 - RNA, 1647 nt, Artificial Sequence
  derived and/or modified sequence opt1 from capsid_protein_VP1__Norovirus__AII02713
augaagauggccagcaacgacgccgcgcccuccaacgacggcgccgccgggcuggugccggagaucaacagcgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucuccgcggcccagaucaccaugugcccccacgugaucguggacguccgccagcuggagcccgugaaccugcccaugcccgacgugcggaacaacuucuuccacuacaaccagggcagcgacucccgccuccggcugaucgccaugcuguacaccccgcuccgcgccaacaacagcggcgacgacgucuucaccguguccugccgggugcugacgcgccccagccccgacuucuccuucaacuuccuggugcccccgaccguggagagcaagaccaagcccuucucccuccccauccugaccaucagcgagauguccaacagccgguuccccgugccgaucgacucccugcacacgagccccaccgagaacaucgucgugcagugccagaacgggcgcgugacccucgacggcgagcugauggggaccacgcagcugcuccccucccagaucugcgccuuccggggcaugcugacccgcagcaccagccgggcguccgaccaggccgacaccgccacgccccgccuguucaacuacuacuggcacauccagcucgacaaccugaacggcaccccguacgaccccgccgaggacauccccgggccgcugggcacccccgacuuccgggggaaggucuucggcguggccagccagcgcaaccccgacgcgaccacgcgggcccacgaggccaagaucgacaccaccuccgggcgcuucacccccaagcucggcagccuggagaucuccacggagagcggcgacuucgaccagaaccagccgaccaucuucacccccguggggaucggcgucgaccacgaggccgacuuccagcaguggacccugcccgacuacgcggggcaguucacgcacaacaugaaccucgcccccgccguggccccgaacuuccccggcgagcagcugcuguucuuccggucccagcuccccagcuccgggggccgcagcaacggcauccuggacugccuggucccccaggagugggugcagcacuucuaccaggaguccgccccgagccagacccagguggcgcucguccgguacgugaaccccgacaccgggcgcgugcuguucgaggccaagcugcacaagcucggcuucaugaccaucgccaaguccggggacagccccaucacggugcccccgaacggcuacuuccgcuucgaguccugggucaaccccuucuacacccuggcccccauggggaccggcaacggccggcgccggauccaguga

SEQ ID NO: 9080 - RNA, 1647 nt, Artificial Sequence; identical to SEQ ID NO: 9053
  derived and/or modified sequence opt1 from capsid_protein_VP1__Norovirus__AII02716

SEQ ID NO: 9081 - RNA, 1650 nt, Artificial Sequence
  derived and/or modified sequence opt1 from capsid_protein_VP1__Norovirus__AII02719
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucaacgccgcccagaucacgaugugcccccacgucaucguggacgugcggcagcucgagcccguccugcugccccuccccgacauccgcaaccgguucuuccacuacaaccaggaggacaccccgcgcaugcggcugguggccaugcuguacacgccccuccgcgccaacuccggcgaggacguguucaccgucagcugccgggugcugacccgccccgcgcccgacuucgaguucaccuuccuggugccgcccaccgucgaguccaagaccaagcccuucacgcuccccauccugacccugggggagcucagcaacucccgguucccggcccccaucgacaugcuguacaccgaccccaacgagggcaucguggugcagccccagaacggccgcugcacccuggacgggacgcuccagggcaccacccagcuggucccgacccagaucugcgccuuccgggggauccugaucggccagacgagccgcucccccgacagcgacuccaccgacagcgcgccccggcgccgggaccacccgcuccacaugcagcuggagaaccuggacggcacccaguacgaccccaccgacgaggugcccgccgcgcucggggccgucgacuucaagggcacgaucuucgggguggccucccagcgcgacaccagcggcacccaggugggggccacccgggcccacgaggucaucaucaacacgaccgacccccgcuacaccccgaagcugggcuccgugcugauguacagcgagagccaggacuucgagaccggccagcccauccgguucacgcccaucgggaugggcgagaacgacuggcaccagugggagcuccccaacuacuccgggcgccugacccugaacaugaaccucgcgccggccguggcccccgccuuccccggcgagcgcauccuguucuuccggagcaucguccccuccgccgggggcuacggcagcgggcagaucgacugccugcucccgcaggagugggugcagcacuucuaccaggaggccgcccccucccagagcgccguggcccugauccgcuacgucaaccccgacaccggccggaacaucuucgaggcgaagcugcaccgcgagggguucaucaccguggccaacuccggcaacaaccccaucguggucccgcccaacggguacuuccgguucgaggccugggugaaccaguucuacacgcucacccccaugggcaccggccaggggcgccggcgcaaccaguga

SEQ ID NO: 9082 - RNA, 1650 nt, Artificial Sequence
  derived and/or modified sequence opt1 from capsid_protein_VP1__Norovirus__AII02722
augaagauggccagcaacgacgccgcgcccuccaacgacggcgccgccaaccuggugccggaggccaacaacgaggucauggcccucgagcccguggcgggggccagcaucgccgcccccguggucggccagcagaacaucaucgaccccuggauccgcgagaacuucgugcaggcgccgcagggggaguucaccgugagcccccggaacucccccggcgagaugcugcugaaccucgagcuggggcccgagcugaacccguaccucucccaccugagccgcauguacaacggcuacgccggcgggaugcagguccagguggugcuggccggcaacgccuucaccgccgggaagaucaucuucgcggccgucccgccccacuuccccguggagaacaucaacgccgcccagaucacgaugugcccccacgugaucgucgacgugcggcagcucgagcccgugcugcugccccuccccgacauccgcaaccgguucuuccacuacaaccaggaggacaccccgcgcaugcggcuggucgccaugcuguacacgccccuccgcgcgaacuccggcgaggacguguucaccgugagcugccggguccugacccgccccgcccccgacuucgaguucaccuuccuggugccgcccaccguggaguccaagaccaagcccuucacgcuccccauccugacccugggggagcucagcaacucccgguucccggcccccaucgacaugcuguacaccgaccccaacgagggcaucgucgugcagccccagaacggccgcugcacccuggacgggacgcuccagggcaccacccagcuggugccgacccagaucugcgccuuccgggggcgccugaucggccagacgagccggucccccgaccucgacagcaccgacuccgcgccccgccggcgcgaccacccgcugcacaugcagcuggagaaccucgacggcacccaguacgaccccaccgacgagguccccgccgcccugggggccguggacuucaagggcacgaucuucggggucgccagccagcgggacaccuccggcagccaggugggggccacccgcgcgcacgaggugaccaucaacacgaccgacccccgguacaccccgaagcugggcuccguccucauguacagcgagagccaggacuucgagaccggccagcccauccgcuucacgcccaucgggaugggcgaggacgacuggcaccagugggagcugcccaacuacuccgggcgccugacccucaacaugaaccuggccccggccguggcccccgcguuccccggcgagcggauccuguucuuccgcagcaucgugcccuccgccgggggcuacggcagcgggcagaucgacugccuccugccgcaggaguggguccagcacuucuaccaggaggccgcccccucccagagcgccguggcgcugauccgguacgugaaccccgacaccggccgcaacaucuucgaggccaagcuccaccgggagggguucaucaccgucgccaacuccggcaacaaccccaucguggugccgcccaacggguacuuccgcuucgaggccugggucaaccaguucuacacgcugacccccaugggcaccggccaggggcggcgccggaaccaguga

SEQ ID NO: 9083 - RNA, 1623 nt, Artificial Sequence
  derived and/or modified sequence opt1 from capsid_protein_VP1__Norovirus__AII02725
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccgugccccuggagaagcuguucacgggccccagcggggccuucgucgugcagccgcagaacggccgcugcaccaccgacgggguccugcugggcaccacgcagcucucccccgugaacaucugcaccuuccggggcgacgugacccacaucgccgggagccgcaacuacaccaugaaccuggccucccugaacuggaacaacuacgaccccacggaggagaucccggcgccccucggcacccccgacuucgucgggaagauccagggcgugcugacccagaccacgaagggggacggcagcacccggggccacaaggccaccguguacaccggguccgcccccuucacgccgaagcugggcagcguccaguucagcaccgacaccgagaacgacuucgagacccaccagaacacgaaguucacccccgugggggugauccaggacggcgggaccacccaccgcaacgagccccagcaguggguccuccccuccuacagcggccgggacgugcacaacgugcaccuggccccggccgucgcgcccacguuccccggcgagcagcuccucuucuuccgcuccaccaugcccgggugcagcggcuacccgaacauggaccuggacugccugcucccccaggagugggugcagcacuucuaccaggaggccgcccccgcccaguccgacguggcgcugcugcgguucgucaaccccgacaccgggcgcguccucuucgagugcaagcugcacaagagcggcuacgugaccguggcccacaccgggcagcacgaccuggugaucccgcccaacggcuacuuccgguucgacuccugggugaaccaguucuacacgcucgcccccaugggcaacgggaccggccgccggcgcgcccuguga

SEQ ID NO: 9084 - RNA, 1623 nt, Artificial Sequence
  derived and/or modified sequence opt1 from capsid_protein_VP1__Norovirus__AII02728
augaagauggccagcaacgacgccaaccccuccgacggcagcgcggccaaccuggugcccgaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgaccccaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcugcugggcaccacgcagcucagccccgucaacaucugcaccuuccggggcgacgugacccacaucgccgggucccgcgacuacaccaugaaccuggccagccugaacuggaacaacuacgacccgacggaggagauccccgcgccccucggcacccccgacuucguggggaagauccagggcguccugacccagaccacgcgcggggacggcuccacccggggccacaaggccaccguguacaccgggagcgccccguucgcccccaagcugggcuccgugcaguucagcacggacaccgagaacgacuucgagacccaccagaacaccaaguucacgcccgucggggugauccaggacggcgggaccacccaccggaacgagccccagcagugggugcucccgagcuacuccggccgcgacguccacaacgugcaccuggcccccgcgguggcccccaccuuccccggcgagcagcuccucuucuuccggagcacgaugccggggugcuccggcuaccccaacauggaccuggacugccugcucccccaggaguggguccagcacuucuaccaggaggccgcccccgcgcagagcgacguggcccugcugcgcuucgugaacccggacaccgggcggguccucuucgagugcaagcugcacaaguccggcuacgugaccguggcccacaccgggcagcacgaccuggucaucccgcccaacggcuacuuccgcuucgacagcugggugaaccaguucuacacccucgcccccaugggcaacgggacgggccggcgccgcgcccuguga

SEQ ID NO: 9085 - RNA, 1653 nt, Artificial Sequence
  derived and/or modified sequence opt1 from capsid_protein_VP1__Norovirus__AII02731
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggacaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggccgccaucgacaugcuguacaccgaccccaacgaguccaucguggugcagccccagaacggccgcugcacccuggacggcacgcuccaggggaccacccagcugguccccacccagaucugcgccuuccggggcacgcugaucagccagaccgcccgcgcggccgacuccaccgacagcccgcagcgggcccgcaaccacccccuccacgugcaggucaagaaccuggacgggacccaguacgaccccacggacgacaucccggccgugcugggcgccaucgacuucaagggcaccguguucggggucgcgucccagcgggacgugagcggcacccaggagcaggggcacuacgccacccgcgcccacgaggcccacaucgacacgaccgaccccaaguacgcgcccaagcucggcaccauccugaucaaguccgagagcaccgacuucaacacgaaccagcccauccgguucaccccgguggggaugggcgacaacaacuggcgccagugggagcugcccgacuacagcggcucccucacccugaacaugaaccuggcccccgccgucagccccuccuucccgggggagcggauccucuucuuccgcagcaucgugcccuccgccggcggguacggcagcggguacaucgacugccugaucccccaggagugggugcagcacuucuaccaggaggccgcgcccucccagagcgccgucgcccuggugcgcuacgugaacccggacaccggccggaacaucuucgaggccaagcuccaccgcgagggcuuccugacggucgccaacuccgggaacaaccccaucguggugccgcccaacggcuacuuccgguucgaggcgugggucaaccaguucuacacccuggcccccauggggagcggccaggggcgccggcgcgcccaguga

SEQ ID NO: 9086 - RNA, 1623 nt, Artificial Sequence; identical to SEQ ID NO: 8835
  derived and/or modified sequence opt1 from capsid_protein_VP1__Norovirus__AII02734

SEQ ID NO: 9087 - RNA, 1623 nt, Artificial Sequence; identical to SEQ ID NO: 8835
  derived and/or modified sequence opt1 from capsid_protein_VP1__Norovirus__AII02737

SEQ ID NO: 9088 - RNA, 1623 nt, Artificial Sequence
  derived and/or modified sequence opt1 from capsid_protein_VP1__Norovirus__AII02740
augaagauggcccccaacgacgccaaccccagcgacggcuccgcggccaaccuggugcccgaggucagcaacgaggugauggcccucgagcccguggucggggccgccaucgcggcccccguggccggccagcagaacgugaucgacccguggauccgcaacaacuucguccaggcccccgggggcgaguucaccgugagcccccggaacgcgcccggggagauccuguggggcgccccgcugggccccgaccucaaccccuaccugucccaccuggcccgcauguacaacggguacgccggcggguucgaggugcaggucauccucgccggcaacgcguucaccgccgggaagaucaucuucgccgccgugcccccgaacuuccccacggagggccugucccccagccaggugaccauguucccccacaucaucgucgacgugcggcagcuggagccggugcucaucccccugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggccgucccccgacuucgacuucaucuuccucgugccgcccaccguggagagccgcacgaagcccuucaccguccccauccugaccguggaggagaugaccaacucccgguuccccaucccccuggagaagcuguucacggggccgagcggcgccuucgugguccagccccagaacgggcgcugcaccaccgacggcgugcugcugggcaccacgcagcucucccccgucaacaucugcaccuuccgcggggacgugacccacaucgccggcagccggaacuacaccaugaaccuggccucccugaacuggaacaacuacgacccgacggaggagauccccgcgccccucgggacccccgacuucgugggcaagauccaggggguccugacccagaccacgaagggcgacggcagcacccgggggcacaaggccaccguguacaccggcuccgccccguucacgcccaagcuggggagcgugcaguucuccaccgacaccgagaacgacuucgagacccaccagaacacgaaguucacccccgucggcgugauccaggacgggggcaccacccaccgcaacgagccccagcagugggugcucccgagcuacagcggccgggacguccacaacgugcaccuggcccccgccguggcgcccacguuccccggggagcagcuccucuucuuccgcuccaccaugccgggcugcagcggguaccccaacauggaccuggacugccugcucccccaggaguggguccagcacuucuaccaggaggccgcccccgcccaguccgacguggcgcugcugcgguucgugaacccggacaccggccgcguccucuucgagugcaagcugcacaagagcggguacgugaccguggcccacaacggccagcacgaccuggucaucccgcccaacggcuacuuccgguucgacuccugggugaaccaguucuacacccucgcccccauggggaacggcacggggcgccggcgcgcccuguga

SEQ ID NO: 9089 - RNA, 1623 nt, Artificial Sequence; identical to SEQ ID NO: 8868
  derived and/or modified sequence opt1 from capsid_protein_VP1__Norovirus__AII02743

SEQ ID NO: 9090 - RNA, 1623 nt, Artificial Sequence; identical to SEQ ID NO: 9068
  derived and/or modified sequence opt1 from capsid_protein_VP1__Norovirus__AII02746

SEQ ID NO: 9091 - RNA, 1623 nt, Artificial Sequence; identical to SEQ ID NO: 8835
  derived and/or modified sequence opt1 from capsid_protein_VP1__Norovirus__AII02749

SEQ ID NO: 9092 - RNA, 1623 nt, Artificial Sequence; identical to SEQ ID NO: 8917
  derived and/or modified sequence opt1 from capsid_protein_VP1__Norovirus__AII02752

SEQ ID NO: 9093 - RNA, 1623 nt, Artificial Sequence; identical to SEQ ID NO: 8882
  derived and/or modified sequence opt1 from capsid_protein_VP1__Norovirus__AII02758

SEQ ID NO: 9094 - RNA, 1623 nt, Artificial Sequence
  derived and/or modified sequence opt1 from capsid_protein_VP1__Norovirus__AII02761
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccaccugaucgucgacgugcggcagcucgagcccgugcugaucccgcugcccgacguccgcaacaacuucuaccacuacaaccaguccaacgaccccaccaucaagcucaucgccaugcuguacacgccccugcgggccaacaacgcgggcgacgacguguucaccgugagcugccgcguccucacccggccgucccccgacuucgacuucaucuuccuggugccgcccaccguggagagccgcacgaagcccuucuccguccccgugcugaccguggaggagaugaccaacagccgguuccccaucccccucgagaagcuguucaccggcccguccagcgccuucgucgugcagccccagaacgggcgcugcacgaccgacggcguccugcucgggaccacccagcugucccccgugaacaucugcacguuccggggcgacgugacccacaucagcggcucccgcaacuacaccaugaaccuggccagccagaacuggaacagcuacgacccgaccgaggagauccccgcgccccucgggacgcccgacuucgucggcaagauccagggggugcugacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccucccguccuacagcgggcggaacauccacaacgugcaccuggcccccgccguggcccccaccuuccccggcgagcagcuccuguucuuccgcuccaccaugccggggugcagcggcuaccccaacauggaccuggacugccugcucccccaggaguggguccaguacuucuaccaggaggcggcccccgcccaguccgacguggcccugcugcgguucgugaacccggacaccggccgcguccucuucgagugcaagcugcacaagagcggguacgugaccguggcgcacaccggccagcacgaccuggucaucccgcccaacggguacuuccgguucgacuccugggugaaccaguucuacacccucgcccccaugggcaacgggacgggccgccgccgggcccuguga

SEQ ID NO: 9095 - RNA, 1623 nt, Artificial Sequence; identical to SEQ ID NO: 8835
  derived and/or modified sequence opt1 from capsid_protein_VP1__Norovirus__AII02764

SEQ ID NO: 9096 - RNA, 1623 nt, Artificial Sequence; identical to SEQ ID NO: 8835
  derived and/or modified sequence opt1 from capsid_protein_VP1__Norovirus__AII02767

SEQ ID NO: 9097 - RNA, 1647 nt, Artificial Sequence; identical to SEQ ID NO: 9053
  derived and/or modified sequence opt1 from capsid_protein_VP1__Norovirus__AII02770

SEQ ID NO: 9098 - RNA, 1623 nt, Artificial Sequence; identical to SEQ ID NO: 8835
  derived and/or modified sequence opt1 from capsid_protein_VP1__Norovirus__AII02773

SEQ ID NO: 9099 - RNA, 1650 nt, Artificial Sequence
  derived and/or modified sequence opt1 from capsid_protein_VP1__Norovirus__AII02776
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucaacgccgcccagaucacgaugugcccccacgucaucguggacgugcggcagcucgagcccguccugcugccccuccccgacauccgcaaccgguucuuccacuacaaccaggaggacaccccgcgcaugcggcugguggccaugcuguacacgccccuccgcgccaacuccggcgaggacguguucaccgucagcugccgggugcugacccgccccgcgcccgacuucgaguucaccuuccuggugccgcccaccgucgaguccaagaccaagcccuucacgcuccccauccugacccugggggagcucagcaacucccgguucccggcccccaucgacaugcuguacaccgaccccaacgagggcaucguggugcagccccagaacggccgcugcacccuggacgggacgcuccagggcaccacccagcuggucccgacccagaucugcgccuuccgggggauccugaucggccagacgagccgcucccccgacagcgacuccaccgacagcgcgccccggcgccgggaccacccgcuccacaugcagcuggagaaccuggacggcacccaguacgaccccaccgacgaggugcccgccgcgcucggggccgucgacuucaagggcacgaucuucgggguggccucccagcgcgacaccagcggcucccaggugggggccacccgggcccacgaggucaucaucaacaccacggacccccgcuacaccccgaagcugggcagcgugcugauguacagcgagucccaggacuucgagaccggccagcccauccgguucacccccaucgggaugggcgagaacgacuggcaccagugggagcuccccaacuacagcgggcgccugacgcugaacaugaaccucgcgccggccguggcccccgccuuccccggcgagcgcauccuguucuuccgguccaucguccccagcgccgggggcuacggcuccgggcagauggacugccugcucccgcaggaguggauccagcacuucuaccaggaggccgcccccagccaguccgccguggcccugauccgcuacgugaaccccgacaccggccggaacaucuucgaggcgaagcugcaccgcgagggguucaucaccgucgccaacagcggcaacaaccccaucguggugccgcccaacggguacuuccgguucgaggccugggucaaccaguucuacacccucacgcccaugggcaccggccaggggcgccggcgcaaccaguga

SEQ ID NO: 9100 - RNA, 1623 nt, Artificial Sequence; identical to SEQ ID NO: 8835
  derived and/or modified sequence opt1 from capsid_protein_VP1__Norovirus__AII02779

SEQ ID NO: 9101 - RNA, 1623 nt, Artificial Sequence; identical to SEQ ID NO: 8835
  derived and/or modified sequence opt1 from capsid_protein_VP1__Norovirus__AII02782

SEQ ID NO: 9102 - RNA, 1623 nt, Artificial Sequence
  derived and/or modified sequence opt1 from capsid_protein_VP1__Norovirus__AII02785
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccagaccaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcuccugggcaccacgcagcucucccccgucaacaucugcaccuuccggggcgacgugacccacaucgccgggagccgcaacuacaccaugaaccuggccuccaucaacuggaacaacuacgaccccacggaggagaucccggcgccccugggcacccccgacuucguggggaagauccagggcguccucacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcugcccuccuacagcggccgggacguccacaacgugcaccucgccccggccguggcgcccacguuccccggcgagcagcugcuguucuuccgcuccaccaugcccgggugcagcggcuacccgaacauggaccucgacugccugcugccccaggaguggguccagcacuucuaccaggaggccgcccccgcccaguccgacgcggcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacgcuggcccccaugggcaacgggaccggccgccggcgcgcccucuga

SEQ ID NO: 9103 - RNA, 1647 nt, Artificial Sequence; identical to SEQ ID NO: 9053
  derived and/or modified sequence opt1 from capsid_protein_VP1__Norovirus__AII02788

SEQ ID NO: 9104 - RNA, 1647 nt, Artificial Sequence; identical to SEQ ID NO: 9053
  derived and/or modified sequence opt1 from capsid_protein_VP1__Norovirus__AII02791

SEQ ID NO: 9105 - RNA, 1623 nt, Artificial Sequence
  derived and/or modified sequence opt1 from capsid_protein_VP1__Norovirus__AII02794
augaagauggccagcuccgacgccaaccccagcgacggcuccaccgcgagccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucgugcucgccgggaacgccuucacggcgggcaagaucaucuucgccgccgugccgcccaacuucccgaccgaggggcugagccccucccaggucaccauguucccccacaucaucguggacgugcggcagcuggagcccguccucaucccgcugcccgacgugcgcaacaacuucuaccacuacaaccagagcaacgaccccaccaucaagcugaucgccaugcucuacacgccccugcgggccaacaacgcgggcgacgacguguucaccgucuccugccgcgugcugacccggccgagccccgacuucgacuucaucuuccucgugccgcccaccgucgagucccgcacgaagcccuucagcgugcccgugcugaccgucgaggagaugaccaacucccgguuccccaucccccuggagaagcuguucaccggcccgagcuccgccuucgugguccagccccagaacgggcgcugcacgaccgacggcgugcuccuggggaccacccagcucagccccgugaacaucugcacguuccggggcgacgucacccacaucuccggcagccgcaacuacaccaugaaccuggccagccaguccuggaacagcuacgacccgaccgaggagauccccgcgccccuggggucccccgacuucgugggcaagauccagggggugcucacgcagaccacccggaccaacggcagcacgcgcgggcacaaggccaccgucuacaccggcuccgccgacuucagcccgaagcugggccgggugcaguucgccaccgacacggacaacgacuucgagaccaaccagaacaccaaguucacccccgugggggucauccaggacggcuccacgacgccccgcaacgagccccagcagugggugcugccgagcuacuccgggcggaacauccacaacgugcaccucgcccccgccgucgcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggguacgugaccgucgcgcacaccggccagcacgaccuggugaucccgcccaacggguacuuccgguucgacagcugggugaaccaguucuacacccuggcccccaugggcaacgggaccggccgccgccgggcccucuga

SEQ ID NO: 9106 - RNA, 1623 nt, Artificial Sequence; identical to SEQ ID NO: 8835
  derived and/or modified sequence opt1 from capsid_protein_VP1__Norovirus__AII02797

SEQ ID NO: 9107 - RNA, 1623 nt, Artificial Sequence; identical to SEQ ID NO: 8835
  derived and/or modified sequence opt1 from capsid_protein_VP1__Norovirus__AII02800

SEQ ID NO: 9108 - RNA, 1623 nt, Artificial Sequence; identical to SEQ ID NO: 9084
  derived and/or modified sequence opt1 from capsid_protein_VP1__Norovirus__AII02803

SEQ ID NO: 9109 - RNA, 1623 nt, Artificial Sequence; identical to SEQ ID NO: 8835
  derived and/or modified sequence opt1 from capsid_protein_VP1__Norovirus__AII02806

SEQ ID NO: 9110 - RNA, 1623 nt, Artificial Sequence; identical to SEQ ID NO: 9068
  derived and/or modified sequence opt1 from capsid_protein_VP1__Norovirus__AII02809

SEQ ID NO: 9111 - RNA, 1647 nt, Artificial Sequence; identical to SEQ ID NO: 9053
  derived and/or modified sequence opt1 from capsid_protein_VP1__Norovirus__AII02812

SEQ ID NO: 9112 - RNA, 1623 nt, Artificial Sequence
  derived and/or modified sequence opt1 from capsid_protein_VP1__Norovirus__AII02815
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucaucgugcagccgcagaacggccgcugcacgaccgacgggguccugcugggcaccacccagcucucccccgugaacaucugcacguuccggggcgacgucacccacaucgccgggagccgcgacuacaccaugaaccuggccucccugaacuggaacaacuacgaccccaccgaggagaucccggcgccccucggcacgcccgacuucguggggaagauccagggcgugcugacccagaccaccaagggggacggcagcacgcggggccacaaggccaccgucuacaccggguccgcccccuucaccccgaagcugggcagcgugcaguucagcacggacaccgagaacgacuucgaggcccaccagaacaccaaguucacccccgugggggucauccaggacggcgggacgacccaccgcaacgagccccagcagugggugcuccccuccuacagcggccgggacgugcacaacguccaccuggccccggcgguggcccccaccuuccccggcgagcagcuccucuucuuccgcuccaccaugcccgggugcagcggcuacccgaacauggaccuggacugccugcucccccaggagugggugcagcacuucuaccaggaggccgcccccgcgcaguccgacgucgcccugcugcgguucgugaaccccgacacggggcgcguccucuucgagugcaagcugcacaagagcggcuacgugaccguggcccacaccgggcagcacgaccuggugaucccgcccaacggcuacuuccgguucgacuccugggucaaccaguucuacacccucgcccccaugggcaacgggaccggccgccggcgcgcccuguga

SEQ ID NO: 9113 - RNA, 1647 nt, Artificial Sequence
  derived and/or modified sequence opt1 from capsid_protein_VP1__Norovirus__AII02818
augaagauggccagcaacgacgccgcgcccuccaacgacggcgccgccgggcuggugccggagaucaacagcgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucuccgcggcccagaucaccaugugcccccacgugaucguggacguccgccagcuggagcccgugaaccugcccaugcccgacgugcggaacaacuucuuccacuacaaccagggcagcgacucccgccuccggcugaucgccaugcuguacaccccgcuccgcgccaacaacagcggcgacgacgucuucaccguguccugccgggugcugacgcgccccagccccgacuucuccuucaacuuccuggugcccccgaccguggagagcaagaccaagcccuucucccuccccauccugaccaucagcgagauguccaacagccgguuccccgugccgaucgacucccugcacacgagccccaccgagaacaucgucgugcagugccagaacgggcgcgugacccucgacggcgagcugauggggaccacgcagcugcuccccucccagaucugcgccuuccggggcaugcugacccgcagcaccagccgggcguccgaccaggccgacaccgucacgccccgccuguucaacuacuacuggcacauccagcucgacaaccugaacggcaccccguacgaccccgccgaggacauccccgggccgcugggcacccccgacuuccgggggaagguguucggcguggccagccagcgcaaccccgacgccaccacgcgggcgcacgaggccaagaucgacaccaccuccgggcgcuucacccccaagcucggcagccuggagaucuccacggagagcgacgacuucuaccagaaccagccgacccgguucacccccgucggcaucgggguggaccacgaggccgacuuccagcaguggacccugcccgacuacgccggccaguucacgcacaacaugaaccucgcgcccgccgucgccccgaacuuccccggggagcagcugcuguucuuccgcucccagcuccccagcuccggcgggcggagcaacggcauccuggacugccuggugccccaggagugggugcagcacuucuaccaggaguccgccccgagccagacccaggucgcccucgugcgcuacgugaaccccgacaccggccgcguccuguucgaggcgaagcugcacaagcucggguucaugaccaucgccaagaacggcgacucccccaucacggugcccccgaacggguacuuccgguucgagagcugggugaaccccuucuacacccuggcccccaugggcaccgggaacggccgccggcgcauccaguga

SEQ ID NO: 9114 - RNA, 1623 nt, Artificial Sequence
  derived and/or modified sequence opt1 from capsid_protein_VP1__Norovirus__AII02821
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucaucgugcagccgcagaacggccgcugcacgaccgacgggguccugcugggcaccacccagcucucccccgugaacaucugcacguuccggggcgacgucacccacaucgccgggagccgcaacuacaccaugaaccuggccucccugaacuggaacaacuacgaccccaccgaggagaucccggcgccccucggcacgcccgacuucguggggaagauccagggcgugcugacccagaccaccaagggggacggcagcacgcggggccacaaggccaccgucuacaccgggggcgcccccuucaccccgaagcugggguccgugcaguucagcacggacaccgagaacgacuucgaggcccaccagaacaccaaguucacccccgugggcgucauccaggacgggggcacgacccaccgcaacgagccccagcagugggugcuccccagcuacuccggccgggacgugcacaacguccaccuggccccggcgguggcccccaccuuccccggggagcagcuccucuucuuccgcagcaccaugcccggcugcuccggguacccgaacauggaccuggacugccugcucccccaggagugggugcagcacuucuaccaggaggccgcccccgcgcagagcgacgucgcccugcugcgguucgugaaccccgacacgggccgcguccucuucgagugcaagcugcacaaguccggguacgugaccguggcccacaccggccagcacgaccuggugaucccgcccaacggcuacuuccgguucgacagcugggucaaccaguucuacacccucgcccccauggggaacggcaccgggcgccggcgcgcccuguga

SEQ ID NO: 9115 - RNA, 1623 nt, Artificial Sequence; identical to SEQ ID NO: 8835
  derived and/or modified sequence opt1 from capsid_protein_VP1__Norovirus__AII02824

SEQ ID NO: 9116 - RNA, 1623 nt, Artificial Sequence; identical to SEQ ID NO: 8835
  derived and/or modified sequence opt1 from capsid_protein_VP1__Norovirus__AII02827

SEQ ID NO: 9117 - RNA, 1623 nt, Artificial Sequence; identical to SEQ ID NO: 8835
  derived and/or modified sequence opt1 from capsid_protein_VP1__Norovirus__AII02830

SEQ ID NO: 9118 - RNA, 1623 nt, Artificial Sequence
  derived and/or modified sequence opt1 from capsid_protein_VP1__Norovirus__AII02833
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucaucgugcagccgcagaacggccgcugcacgaccgacgggguccugcugggcaccacccagcucucccccgugaacaucugcacguuccggggcggggucacccacaucgccggcagccgcaacuacaccaugaaccuggccucccugaacuggaacaacuacgaccccaccgaggagaucccggcgccccucgggacgcccgacuucgugggcaagauccagggggugcugacccagaccaccaagggcgacggcagcacgcgggggcacaaggccaccgucuacaccggcuccgcccccuucaccccgaagcuggggagcgugcaguucagcacggacaccgagaacgacuucgaggcccaccagaacaccaaguucacccccgugggcgucauccaggacgggggcacgacccaccgcaacgagccccagcagugggugcuccccuccuacagcggccgggacgugcacaacguccaccuggccccggcgguggcccccaccuuccccggggagcagcuccucuucuuccgcuccaccaugcccggcugcagcggguacccgaacauggaccuggacugccugcucccccaggagugggugcagcacuucuaccaggaggccgcccccgcgcaguccgacgucgcccugcugcgguucgugaaccccgacacgggccgcguccucuucgagugcaagcugcacaagagcggguacgugaccguggcccacaccggccagcacgaccuggugaucccgcccaacggcuacuuccgguucgacuccugggucaaccaguucuacacccucgcccccauggggaacggcaccgggcgccggcgcgcccuguga

SEQ ID NO: 9119 - RNA, 1623 nt, Artificial Sequence
  derived and/or modified sequence opt1 from capsid_protein_VP1__Norovirus__AII02836
augaagauggccagcaacgacgccaaccccuccgacggcagcgcggccaaccuggugccggaggucuccaacgaggugauggcccucgagcccguggccggggccgcgaucgccgcccccgucgccggccagcagaacgugaucgaccccuggauccgcaacaacuucgugcaggcgcccgggggcgaguucaccgucagcccccggaacgcccccggggagauccugugguccgcgccccugggcccggaccucaaccccuaccugagccaccuggcccgcauguacaacggcuacgccgggggcuucgagguccaggugauccucgccgggaacgccuucaccgccggcaagaucaucuucgccgccgugccgcccaacuucccgacggaggggcugucccccagccaggugaccauguucccccacaucaucguggacguccggcagcuggagcccgugcucaucccgcugcccgacgugcgcaacaacuucuaccacuacaaccagaccaacgacuccaccaucaagcugaucgcgaugcucuacacgccccugcgggccaacaacgccggcgaggacgucuucaccgugagcugccgcgugcugacccggcccuccccggacuucgacuucaucuuccucgucccgcccaccguggagagccgcacgaagcccuucaccgugcccauccugaccgucgaggagaugaccaacucccgguuccccaucccccuggagaagcuguucacgggccccagcggggccuucguggugcagccgcagaacggccgcugcaccaccgacgggguccugcugggcaccacgcagcucucccccgugaacaucugcaccuuccggggcgacgucacccacaucgccgggagccgcaacuacaccaugaaccuggcgucccugaacuggaacaacuacgaccccacggaggagaucccggcgccccucggcacccccgacuucguggggaagauccagggcgugcugacccagaccacgaagggggacggcagcacccggggccacaaggccaccgucuacaccggguccgcccccuucacgccgaagcugggcagcgugcaguucagcaccgacaccgagaacgacuucgagacccaccagaacacgaaguucacccccgugggggucauccaggacggcgggaccacccaccgcaacgagccccagcagugggugcuccccuccuacagcggccgggacgugcacaacguccaccuggccccggccguggcccccacguuccccggcgagcagcuccucuucuuccgcuccaccaugcccgggugcagcggcuacccgaacauggaccuggacugccugcucccccaggagugggugcagcacuucuaccaggaggccgcccccgcgcaguccgacgucgcccugcugcgguucgugaaccccgacaccgggcgcguccucuucgagugcaagcugcacaagagcggcuacgugaccguggcccacaccgggcagcacgaccuggugaucccgcccaacggcuacuuccgguucgacuccugggucaaccaguucuacacgcucgcccccaugggcaacgggaccggccgccggcgcgcccuguga

SEQ ID NO: 9120 - RNA, 1623 nt, Artificial Sequence; identical to SEQ ID NO: 8909
  derived and/or modified sequence opt1 from capsid_protein_VP1__Norovirus__AII02839

SEQ ID NO: 9121 - RNA, 1623 nt, Artificial Sequence; identical to SEQ ID NO: 8917
  derived and/or modified sequence opt1 from capsid_protein_VP1__Norovirus__AII02842

SEQ ID NO: 9122 - RNA, 1647 nt, Artificial Sequence; identical to SEQ ID NO: 9053
  derived and/or modified sequence opt1 from capsid_protein_VP1__Norovirus__AII02845

SEQ ID NO: 9123 - RNA, 1647 nt, Artificial Sequence; identical to SEQ ID NO: 9053
  derived and/or modified sequence opt1 from capsid_protein_VP1__Norovirus__AII02848

SEQ ID NO: 9124 - RNA, 1623 nt, Artificial Sequence; identical to SEQ ID NO: 8868
  derived and/or modified sequence opt1 from capsid_protein_VP1__Norovirus__AII02851

SEQ ID NO: 9125 - RNA, 1623 nt, Artificial Sequence; identical to SEQ ID NO: 8835
  derived and/or modified sequence opt1 from capsid_protein_VP1__Norovirus__AII02854

SEQ ID NO: 9126 - RNA, 1623 nt, Artificial Sequence
  derived and/or modified sequence opt1 from capsid_protein_VP1__Norovirus__AII02857
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucaucgugcagccgcagaacggccgcugcacgaccgacgggguccugcugggcaccacccagcucucccccgugaacaucugcacguuccggggcgacgucacccacaucgccgggagccgcaacuacaccaugaaccuggccucccugaacuggaacaacuacgaccccaccgaggagaucccggcgccccucggcacgcccgacuucguggggaagauccagggcgugcugacccagaccaccaagggggacggcagcacgcggggccacaaggccaccgucuacaccggguccgcccccuucaccccgaagcugggcagcgugcaguucagcacggacaccgagaacgacuucgaggcccaccagaacaccaaguucacccccgugggggucauccaggacggcgggacgacccaccgcaacgagccccagcagugggugcuccccuccuacagcggccgggacgugcacaacguccaccuggccccggcgguggcccccaccuuccccggcgagcagcuccucuucuuccgcuccaccaugcccgggugcagcggcuacccgaacauggaccuggacugccugcucccccaggagugggugcagcacuucuaccaggaggccgcccccgcgcaguccgacgucgcccugcugcgguucgugaaccccgacacggggcgcguccucuucgagugcaagcugcacaagccgggcuacgugaccguggcccacaccgggcagcacgaccuggugaucccgcccaacggcuacuuccgguucgacagcugggucaaccaguucuacacccucgcccccaugggcaacgggaccggccgccggcgcgcccuguga

SEQ ID NO: 9127 - RNA, 1623 nt, Artificial Sequence; identical to SEQ ID NO: 8835
  derived and/or modified sequence opt1 from capsid_protein_VP1__Norovirus__AII02860

SEQ ID NO: 9128 - RNA, 1623 nt, Artificial Sequence; identical to SEQ ID NO: 8835
  derived and/or modified sequence opt1 from capsid_protein_VP1__Norovirus__AII02866

SEQ ID NO: 9129 - RNA, 1623 nt, Artificial Sequence
  derived and/or modified sequence opt1 from capsid_protein_VP1__Norovirus__AII02869
augaagauggccagcaacgacgccaaccccaccgacggcuccgcggccaaccuggugccggaggucagcaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagaccaacgacagcacgaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucaccguccccauccugaccguggaggagaugacgaacagccgguuccccaucccccuggagaagcuguucaccggccccuccggggccuucgugguccagccgcagaacggccgcugcaccaccgacggggugcugcugggcacgacccagcucagccccgucaacaucugcaccuuccggggcgacgugacccacaucgccgggucccgcaacuacacgaugaaccuggccagccugaacuggaacaacuacgaccccaccgaggagaucccggcgccccucggcacccccgacuucguggggaagauccagggcguccugacccagacgaccaagggggacggcuccacccggggccacaaggccaccguguacacggggagcgcccccuucaccccgaagcugggcuccgugcaguucagcaccgacaccgagaacgacuucgagacgcaccagaacaccaaguucacccccgucggggugauccaggacggcgggaccacgcaccgcaacgagccccagcagugggugcuccccagcuacuccggccgggacguccacaacgugcaccuggccccggccguggcgcccaccuuccccggcgagcagcuccucuucuuccgcagcaccaugcccgggugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacacggggcagcacgaccuggucaucccgcccaacggcuacuuccgguucgacagcugggugaaccaguucuacacccucgcccccaugggcaacgggaccggccgccggcgcgcccuguga

SEQ ID NO: 9130 - RNA, 1623 nt, Artificial Sequence; identical to SEQ ID NO: 8835
  derived and/or modified sequence opt1 from capsid_protein_VP1__Norovirus__AII02872

SEQ ID NO: 9131 - RNA, 1623 nt, Artificial Sequence; identical to SEQ ID NO: 8835
  derived and/or modified sequence opt1 from capsid_protein_VP1__Norovirus__AII02875

SEQ ID NO: 9132 - RNA, 1647 nt, Artificial Sequence; identical to SEQ ID NO: 9053
  derived and/or modified sequence opt1 from capsid_protein_VP1__Norovirus__AII02878

SEQ ID NO: 9133 - RNA, 1623 nt, Artificial Sequence; identical to SEQ ID NO: 8835
  derived and/or modified sequence opt1 from capsid_protein_VP1__Norovirus__AII02881

SEQ ID NO: 9134 - RNA, 1623 nt, Artificial Sequence; identical to SEQ ID NO: 8835
  derived and/or modified sequence opt1 from capsid_protein_VP1__Norovirus__AII02884

SEQ ID NO: 9135 - RNA, 1647 nt, Artificial Sequence; identical to SEQ ID NO: 9053
  derived and/or modified sequence opt1 from capsid_protein_VP1__Norovirus__AII02887

SEQ ID NO: 9136 - RNA, 1623 nt, Artificial Sequence; identical to SEQ ID NO: 8917
  derived and/or modified sequence opt1 from capsid_protein_VP1__Norovirus__AII02890

SEQ ID NO: 9137 - RNA, 1623 nt, Artificial Sequence; identical to SEQ ID NO: 8870
  derived and/or modified sequence opt1 from capsid_protein_VP1__Norovirus__AII02893

SEQ ID NO: 9138 - RNA, 1623 nt, Artificial Sequence
  derived and/or modified sequence opt1 from capsid_protein_VP1__Norovirus__AII02896
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcgggucauccucgccgggaacgccuucaccgccggcaagaucaucuucgccgccgugccgcccaacuucccgacggaggggcugucccccagccaggugaccauguucccccacaucaucgucgacgugcgccagcuggagcccgugcucaucccgcugcccgacguccggaacaacuucuaccacuacaaccagaccaacgacuccaccaucaagcugaucgccaugcucuacacgccccugcgcgcgaacaacgccggcgaggacguguucaccgugagcugccggguccugacccgccccuccccggacuucgacuucaucuuccucgugccgcccaccguggagagccggacgaagcccuucaccguccccauccugaccguggaggagaugaccaacucccgcuuccccaucccccuggagaagcuguucacgggccccagcggggccuucgugguccagccgcagaacggccggugcaccaccgacggggugcugcugggcaccacgcagcucucccccgucaacaucugcaccuuccgcggcgacgugacccacaucgccgggagccggaacuacaccaugaaccuggccucccugaacuggaacaacuacgaccccacggaggagaucccggcgccccucggcacccccgacuucguggggaagauccagggcguccugacccagaccacgaagggggacggcagcacccgcggccacaaggccaccguguacaccggguccgcccccuucacgccgaagcugggcagcgugcaguucagcaccgacaccgagaacgacuucgagauccaccagaacaccaaguucacgcccgucggggugauccaggacggcgggaccacccaccggaacgagccccagcagugggugcuccccuccuacagcggccgcgacguccacaacgugcaccuggccccggccguggcgcccaccuuccccggcgagcagcuccucuucuuccgguccacgaugcccgggugcagcggcuacccgaacauggaccuggacugccugcucccccaggaguggguccagcacuucuaccaggaggccgcccccgcccaguccgacguggcgcugcugcgcuucgugaaccccgacaccgggcggguccucuucgagugcaagcugcaccgcagcggcuacgugaccguggcccacaccgggcagcacgaccuggucaucccgcccaacggcuacuuccgguucgacuccugggugaaccaguucuacacccucgcccccaugggcaacgggacgggccgccgccgggcccuguga

SEQ ID NO: 9139 - RNA, 1647 nt, Artificial Sequence
  derived and/or modified sequence opt1 from capsid_protein_VP1__Norovirus__AII02899
augaagauggccagcaacgacgccgcgcccuccaacgacggcgccgccgggcuggugccggagaucaacagcgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucuccgcggcccagaucaccaugugcccccacgugaucguggacguccgccagcuggagcccgugaaccugcccaugcccgacgugcggaacaacuucuuccacuacaaccagggcagcgacucccgccuccggcugaucgccaugcuguacaccccgcuccgcgccaacaacagcggcgacgacgucuucaccguguccugccgggugcugacgcgccccagccccgacuucuccuucaacuuccuggugcccccgaccguggagagcaagaccaagcccuucucccuccccauccugaccaucagcgagauguccaacagccgguuccccgugccgaucgacucccugcacacgagccccaccgagaacaucgucgugcagugccagaacgggcgcgugacccucgacggcgagcugauggggaccacgcagcugcuccccucccagaucugcgccuuccggggcaugcugacccgcagcaccagccgggcguccgaccaggccgacaccgccacgccccgccuguucaacuacuacuggcacauccagcucgacaaccugaacggcaccccguacgaccccgccgaggacauccccgggccgcugggcacccccgacuuccgggggaaggucuucggcguggccagccagcgcaaccccgacgcgaccacgcgggcccacgaggccaagaucgacaccaccuccgggcgcuucacccccaagcucggcagccuggagaucuccacggagagcggcgacuucgaccagucccagccgacccgguucacccccguggggaucggcgucgaccacgaggccgacuuccagcaguggacccugcccgacuacgcggggcaguucacgcacaacaugaaccucgcccccgccguggccccgaacuuccccggcgagcagcugcuguucuuccgcagccagcuccccuccagcgggggccgguccaacggcauccuggacugccuggucccccaggagugggugcagcacuucuaccaggagagcgccccgucccagacccagguggcgcucguccgcuacgugaaccccgacaccgggcgcgugcuguucgaggccaagcugcacaagcucggcuucaugaccaucgccaagagcggggacucccccaucacggugcccccgaacggcuacuuccgguucgagagcugggucaaccccuucuacacccuggcccccauggggaccggcaacggccgccggcgcauccaguga

SEQ ID NO: 9140 - RNA, 1623 nt, Artificial Sequence; identical to SEQ ID NO: 8835
  derived and/or modified sequence opt1 from capsid_protein_VP1__Norovirus__AII02902

SEQ ID NO: 9141 - RNA, 1647 nt, Artificial Sequence
  derived and/or modified sequence opt1 from capsid_protein_VP1__Norovirus__AIS24557
augaagauggccagcaacgacgccgcgcccuccaacgacggcgccgccgggcuggugccggagaucaacaacgaggccauggcccucgaccccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaccgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucacggugagcugccgggugcugacccgccccucccccgacuucagcuucaacuuccuggugcccccgaccguggaguccaagaccaagcccuucacgcuccccauccugaccaucagcgagauguccaacagccgguuccccgugccgaucgacucccugcacaccagccccaccgacaacaucgucgugcagugccagaacgggcgcgugacgcucgacggcgagcugauggggaccacccagcugcuccccucccagaucugcgccuuccggggcguccugacccgcagcacgucccgggcgagcgaccaggccgacgccgccacgccccgccuguucaacuacuacuggcacauccagcucgacaaccugaacggcaccccguacgaccccgccgaggacauccccgcgccgcuggggacccccgacuuccggggcaagguguucgggguggccagccagcgcaaccccgacuccaccacccgggcccacgaggccaaggucgacaccaccagcggccgcuucacgcccaagcucgggucccuggagaucagcaccgaguccggcgacuucgaccagaaccagccgacccgguucacccccgugggcaucggggucgacaacgaggcggacuuccagcaguggacgcugcccgacuacagcggccaguucacccacaacaugaaccucgcccccgccguggccccgaacuuccccggggagcagcugcuguucuuccgcucccagcuccccagcuccggcgggcggagcaacggcauccuggacugccuggugccccaggaguggguccagcacuucuaccaggaguccgccccggcgcagacccagguggcccucgugcgcuacgucaaccccgacaccggccgcgugcuguucgaggccaagcugcacaagcucggguacaugacgaucgccaagagcggcgacucccccaucaccgugcccccgaacggguacuuccgguucgagagcugggucaaccccuucuacacccuggcccccaugggcaccgggaacggccgccggcgcauccaguga

SEQ ID NO: 9142 - RNA, 1620 nt, Artificial Sequence
  derived and/or modified sequence opt1 from capsid_protein_VP1__Norovirus__AIY30135
augcgcaugagcgacggcgccgcccccaaggcggacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugauccagccccgccucugcacccacgcccgguggcccgccccggucuacggccugcugguggaccccagccuccccuccaacccccaguggcagaacgggcgcgugcacgucgacggcacccugcugggcaccaccccggugagcggguccugggucagcugcuucgcggccgaggccgccuacgaguuccaguccggcaccggccagguggccacguucacccucaucgagcaggacgggagcgcguacgugcccggggaccgggccgcgccccugggcuacccggacuucuccggccagcuggagaucgagguccagaccgagaccacgaagaccggggacaagcucaaggugaccaccuucgagaugauccugggccccacgaccaacguggaccaggcccccuaccaggggaaggucuucgccagcaucaccgccgccgccagccuggaccucguggacggccgcgugcgggccgucccccgcuccaucuacggguuccaggacgugaucccggaguacaacgacggccugcuggugccccucgcgccgcccaucggccccuuccugcccggggagguccugcuccgguuccgcaccuacaugcggcagcuggacacggccgacgccgccgccgaggcgaucgacugcgcccugccccaggaguucaucagcugguucgccuccaacguguucaccgugcagagcgaggcccuccugcugcgcuaccggaacacccucaccggccagcugcuguucgagugcaagcuguacuccgagggguacaucgcccucagcuacuccggcagcgggccccugacguucccgaccgacggcuucuucgaggucguguccugggugccccgccuguaccagcucgcgagcgucggcucccuggccaccgggcgcacccuguga

SEQ ID NO: 9143 - RNA, 1623 nt, Artificial Sequence
  derived and/or modified sequence opt1 from capsid_protein_VP1__Norovirus__AKE07100
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccaucagcccccggaacgcccccggggagauccugugguccgcgccccugggcccggaccucaaccccuaccugagccaccuggcccgcauguacaacggcuacgccgggggcuucgagguccaggugauccucgccgggaacgccuucacggcgggcaaggugaucuucgccgccgugccgcccaacuucccgaccgaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccauccccgugcugaccaucgaggagaugaccaacagccgguuccccaucccccuggagaagcuguucaccggcccguccagcgccuucgugguccagccccagaacgggcgcugcuccacggacggcgugcugcuggggaccacccagcucagccccgucaacaucugcaccuuccggggcgacgugacgcacaucgccggcucccacaacuacaccaugaaccuggccagccagaacuggaacagcuacgacccgaccgaggagauccccgcgccccuggggacccccgacuucgugggcaagauccaggggguccucacgcagaccacccgcgccgacggcuccacccgggggcacaaggccacggugcugaccggcagcgccaacuucaccccgaagcugggccgcauccaguucgccaccgacacggacaacgacuucgagaccaaccagaacaccaaguucacccccgugggggucauccaggacggcgacacggcccaccggaacgagccccagcagugggugcuccccuccuacagcgggcgcaacacccacaacgugcaccuggcgccggccgucgcccccaccuuccccggcgagcagcuccucuucuuccgguccaccauccccgggugcagcggcuacccgaacauggaccuggacugccugcucccccaggagugggugcaguucuucuaccaggaggccgcgcccgcccaguccgacguggcccugcugcgcuucgucaaccccgacacgggccggguccucuucgagugcaagcugcacaagagcggguacaucaccguggcccacaccggccagcacgaccuggugaucccgcccaacggguacuuccgcuucgacuccugggugaaccaguucuacacccucgcccccaugggcaacgggaccggccggcgccgcgcgcuguga

SEQ ID NO: 9144 - RNA, 1623 nt, Artificial Sequence
  derived and/or modified sequence opt1 from capsid_protein_VP1__Norovirus__AKE07103
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggagucccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggcgaacaacgccggggacgacguguucaccguguccugccgcguccugacccggccgagccccgacuucgacuucaucuuccucgugccgcccaccguggagucccgcaccaagcccuucagcguccccauccugacgguggaggagaugaccaacucccgguuccccaucccccuggagaagcuguucaccggcccgagcuccgccuucgugguccagccccagaacggccgcugcaccaucgacggggugcugcugggcacgacccagcucagccccgucaacaucugcaccuuccgcggggacgugacccacaucgccggcacgcacaacuacaccaugaaccuggccacccagaacuggaacuccuacgacccgaccgaggagauccccgcgccccugggcacgcccgacuucguggggaagauccagggcguccucacccagaccaccaagacggacgggagcacccggggccacaaggccaccgugugcaucgggagcgccgacuucgccccgaagcugggccgggugcaguucgagaccgacacgaacaacgaccuggagaccaaccagaacaccaaguucacccccgucggcgugauccagaacggggagacggcccaccgcaacgagccccagcagugggugcuccccuccuacagcggccggaacaccccgaacguccaccuggcgcccgccguggcccccaccuuccccggggagcagcuccucuucuuccgcuccaccaugccgggcugcagcggguaccccaacauggaccuggacugccugcucccccaggagugggugcaguacuucuaccaggaggccgcgcccgcccaguccgacgucgcccugcugcgguucgugaacccggacacgggccgcguccucuucgagugcaagcugcacaagagcggcuacgugaccguggcccacaccgggucccacgaccuggugaucccgcccaacggcuacuuccgguucgacagcugggucaaccaguucuacacccucgcccccauggggaacggcaccgggcgccggcgcgcgacguga

SEQ ID NO: 9145 - RNA, 1623 nt, Artificial Sequence
  derived and/or modified sequence opt1 from capsid_protein_VP1__Norovirus__AKE07106
augaagauggccagcuccgacgccaaccccagcgacggcuccaccgcgaaccuggugccggaggucaacgacgaggugauggcccucgagcccguggucggggccgcccuggccgcgcccguggccggccagcagaacgugaucgaccccuggauccgcaacaacuucguccaggcccccgggggcgaguucaccgugagcccccggaacgcccccggggagauccugugguccgcgccccucggcccggaccugaaccccuaccugagccaccucgcccgcauguacaacggcuacgccgggggcuucgaggugcaggucauccuggccgggaacgccuucacggcgggcaaggugaucuucgccgccgugccgcccaacuucccgaccgaggggcugucccccagccaggucaccauguucccccacaucaucguggacgugcggcagcucgagcccguccugaucccgcugcccgacgcccgcaacaacuucuaccacuacaaccaguccaacgagagcaccaucaagcucaucgccaugcuguacacgccccugcgggcgaacaacgccggcgacgacguguucaccguguccugccgcguccucacccggcccagccuggacuucgacuucaucuuccuggugccgcccaccguggagucccgcacgaagcccuucagcguccccauccucaccguggaggagaugaccaacucccgguucccgaucccccuggagcgccuguucaccggccccagcuccgccuucgccgugcagccccagaacgggcggugcacgaccgacggcguccuccuggggaccacccagcugagcccggugaacaucugcacguuccgcggcgacgucacccacaccaccggcucccacaacuacacgaugaaccucgccagccagaaccggagcaacuacgaccccaccgaggagauccccgcgccgcuggggacccccgacuucgugggcaagauccagggggcccugacccagacgacccgcgccgacggcuccacccgggggcacaaggccaccguguacacgggcagcgccgacuucacccccaagcucggccgcguccaguucgcgaccgacaccgaccacgacuucgacacgaaccagaacaccaaguucacccccgugggggugauccaggacggcuccaccacgcaccggaacgagccgcagcaguggguccugcccagcuacuccgggcgcaacacccacaacgugcaccuggcccccgccguggcccccaccuucccgggcgagcagcuccuguucuuccggagcaccaugcccgggugcuccggcuaccccaacauggaccuggacugccuccugccccaggagugggucgcgcacuucuaccaggaggccgccccggcccagagcgacguggcccugcuccgcuucgugaaccccgacaccggccggguccuguucgagugcaagcugcacaaguccggguacgugacgguggcgcacaccggccagcacgaccucgucaucccgcccaacggguacuuccgcuucgacagcugggugaaccaguucuacacccuggcccccaugggcaacgggaccggccgccggcgcgcccuguga

SEQ ID NO: 9146 - RNA, 1719 nt, Artificial Sequence
  derived and/or modified sequence opt1 from capsid_protein_VP1__Norovirus__ALQ12260
augaagauggccagcaacggcgccgcggcccccucccaggacggggccgccaaccuggugccggagagccagcaggagguccucgcccuggagcccguggcgggcgccgcccuggccgcgcccguggccgggcaguucaacgccaucgaccccuggaucaagcagaacuucguccaggccccggccggcgaguucaccgugagcccccgcaacgcgcccggggaggugcucauggaccuggagcugggccccgagaugaacccguuccucgcccaccuggcccagauguacaacgccuacgccggcgggauggagguccagaucauccuggcgggcaacgccuucaccgccgggaagaucaucgugugcgccgugccgcccaacuucccgcccgaccggcucuccgccucccaggcgacgaacuucccccacgucaucauggacgugcgcacccuggagcccgugguccugccccuccccgacgugcgggccggcuucuuccacuacaaccagcugcgcgagccccggaugcgccugaugacccuccuguacacgccccugcgggccaacgggaccggcgacgacgccuucaccgugagcugccgcguccucacccggcccaugcuggacuucgaguucauguuccuggugccgcccaccguggagucccgcgucacgcccuucagcgugcccaccuacccgguggucgagaugaccaacucccgguggcccgcccgcaucagcggcaugcacgugaacgcgaaccagacccucgccgugcaguuccagaacgggcggugcacgcuggacggccagcugauggggaccacccagcucugcgccgccgacgucugccgcaugcggggccgcuacaccuccacgcgggcggaccccgccggccuggggugggaccuggacgccaccacccucguggacggccccgaggcccgcguccaggcccggaucagcguguccgcgcaccuccagcuggaggagcugagcgggcagccguacgagguguacggcgagcagcccgcgccccuggggaccccggacuuccagugccgccugaugggcgagcucguccggcugcccuccgccaaccccguggcccagagccgcuuccgcgacgccuucuucgacacguacggcgcccuguucgcccccgccgugggguccgucaccgugaccgugaacaacagcuccagcagcgacuucgccaacgaccagccguucgaguuccuccccaucggcgucgagaucgggaacuccgcccgguacgacgaguucgcgcugcccagcuacaacggcgccaucggggagaaccgccaccuggcccccaucgccgcgccgggcuuccccggcgagaaccucaucuucuucuccagcaaccugcccgugugggacuccaccagcgcccaguccaaccggcgcaucagcugccugcuccccaacgaguucauccagcacuucuacgaccugcaggccccgucccagagcgacguggcccugcuccgguacguccaccccgagacggaccgcuuccuguucgagugcaagcuguaccgggacgccuuccucaccgugaacggggcguccuacgccgaguuccccgugaacggcuacagccgcuucgacuccugggucaagcaguucuucacccugagccccguggggaccggcuccgggcggcgcggccggagccgcaaggcccaguga

SEQ ID NO: 9147 - RNA, 1620 nt, Artificial Sequence
  derived and/or modified sequence opt1 from capsid_protein_VP1__Norovirus__BAI49904
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaagagccgguuccccaucccccuggagaagcucuacaccggccccuccagcgccuucgugguccagccgcagaacgggcgcugcacgaccgacggcgugcugcuggggaccacccagcucuccgucgugaacaucugcacguuccggggcgacgugacccacaucgccggcagccacgacuacaccaugaaccuggccucccagaacuggaacaacuacgaccccaccgaggagauccccgccccgcuggggacgcccgacuucgucggcaagauccaggggaugcucacccagaccacccgcgaggacggcagcacgcgggcgcacaaggccaccgugagcaccggguccgugcacuucacccccaagcugggcagcguccaguacacgaccgacaccaacaacgacuuccagaccggccagaacacgaaguucacccccgugggggugauccaggacggcaacaaccaccagaacgagccgcagcaguggguccugcccaacuacuccgggcgcaccggccacaacgugcaccucgcccccgccguggcccccaccuucccgggggagcagcugcuguucuuccggagcacgaugcccggcugcuccggcuaccccaacaugaaccucgacugccugcugccccaggaguggguccagcacuucuaccaggaggcggccccggcccagagcgacguggcccuccugcgcuucgugaaccccgacaccgggcgguuccuguucgagugcaagcuccacaaguccggcuacgucaccguggcgcacaccgggccccacgaccuggugaucccgcccaacggcuacuuccgcuucgacagcugggucaaccaguucuacacccuggcccccauggggaacggcgccggccggcgccgggugcucuga

SEQ ID NO: 9148 - RNA, 1623 nt, Artificial Sequence
  derived and/or modified sequence opt1 from capsid_protein_VP1__Norovirus__BAI49905
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccagcacccgcacguaccggaugaaccuggccucccagaacuggaacaacuacgacccgaccgaggagauccccgcgccccugggcacccccgacuucguggggaagauccagggcaugcucacccagacgaccaagggggacggcagcacccgcgggcacaaggccaccgucagcacgggcuccguggacuucaccccgaagcugggcagcgugcaguucgccaccgacaccgacaacgacuucgagacggggcagaacacccgguucacccccgucggcgugauccaggacggguccagcgcccaccgcaacgagccccagcagugggugcugcccgacuacuccggccggaccguccacaacgugcaccucgccccggccguggcccccacguuccccggggagcagcugcuguucuuccgcagcaccaugcccggcugcuccggcuacccgaacauggaccucgacugccugcugccccaggaguggguccagcacuucuaccaggaggcggcccccgcccagagcgacguggcccuccugcgguucgugaaccccgacaccgggcgcguccuguucgagugcaagcuccacaagaccggcuacgugaccguggcgcacacggggcagcacgaccuggucaucccgcccaacggcuacuuccgguucgacuccugggugaaccaguucuacacccuggcccccauggggaacggcgccggccgccgccgggcccucuga

SEQ ID NO: 9149 - RNA, 1623 nt, Artificial Sequence
  derived and/or modified sequence opt1 from capsid_protein_VP1__Norovirus__BAI49906
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccacggccacaaggccaccgucagcacgggcagcguggacuucaccccgaagcugggguccgugcaguucgccaccgacaccgacaacgacuucgagacgggccagaacacccgcuucacccccgucggggugauccaggacggcagcuccgcccaccggaacgagccccagcagugggugcugcccgacuacagcgggcgcaccguccacaacgugcaccucgccccggccguggcccccacguuccccggcgagcagcugcuguucuuccgguccaccaugcccggcugcagcggguacccgaacauggaccucgacugccugcugccccaggaguggguccagcacuucuaccaggaggcggcccccgcccaguccgacguggcccuccugcgcuucgugaaccccgacaccggccggguccuguucgagugcaagcuccacaagaccggguacgugaccguggcgcacacgggccagcacgaccuggucaucccgcccaacggguacuuccgcuucgacagcugggugaaccaguucuacacccuggcccccaugggcaacggcgccgggcggcgccgcgcccucuga

SEQ ID NO: 9150 - RNA, 1623 nt, Artificial Sequence
  derived and/or modified sequence opt1 from capsid_protein_VP1__Norovirus__BAI49907
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggguccucacccagacgacccgcggcgacggguccacccggggccacaaggccaccgugagcacgggcagcguggacuucaccccgaagcugggguccguccaguucgccaccgacaccgacaacgacuucgagacgggccagaacacccgcuucacccccgugggggugauccaggacggcagcuccgcccaccggaacgagccccagcaguggguccugcccgacuacagcgggcgcaccgugcacaacgugcaccucgccccggccgucgcccccacguuccccggcgagcagcugcuguucuuccgguucaccaugcccggcugcuccggguacccgaacauggaccucgacugccugcugccccaggagugggugcagcacuucuaccaggaggcggcccccgcccagagcgacguggcccuccugcgcuucgucaaccccgacaccggccgggugcuguucgagugcaagcuccacaagaccggguacgugaccgucgcgcacacgggccagcacgaccuggugaucccgcccaacggguacuuccgcuucgacuccugggugaaccaguucuacacccuggcccccaugggcaacggcgccgggcgccggcgcgcccucuga

SEQ ID NO: 9151 - RNA, 1623 nt, Artificial Sequence
  derived and/or modified sequence opt1 from capsid_protein_VP1__Norovirus__BAI49909
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcaccuacaacggcuacgccgggggcuucgaggugcaggucauccucgccgggaacgccuucaccgcgggcaagaucaucuucgccgccgugccgcccaacuucccgaccgaggggcugagccccucccaggugacgauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcaccaagcccuucuccguccccauccugaccguggaggagaugacgaacagccgguuccccaucccccuggagaagcuguucaccggccccuccagcgccuucgugguccagccgcagaacgggcgcugcaccaccgacggcgugcuccuggggacgacccagcucucccccgucaacaucugcaccuuccggggcgacgugacccacaucgccggcacgcagaacuacaccaugaaccuggccagccagaacuggaacaacuacgaccccaccgaggagaucccggcgccccuggggacccccgacuucgugggcaagauccaggggguccucacgcagaccacccgccgggacggcuccacccgcgggcacaaggccacggugagcaccggcagcgugcacuucacccccaagcugggcuccguccaguucagcaccgacacguccaacgacuucgagaccgggcagaacacccgguucaccccggugggcgugguccaggacgggagcacgacccaccagaacgagccccagcagugggugcugcccaacuacuccggccgcgacagccacaacgugcaccucgcccccgccgucgccccgaccuuccccggggagcagcugcuguucuuccgguccaccaugcccggcugcagcggcuaccccaacaugaaccucgacugccugcugccgcaggagugggugcagcacuucuaccaggaguccgcccccgcgcagagcgacguggcccuccugcgcuucgucaaccccgacaccgggcgggugcuguucgagugcaagcuccacaaguccggcuacgugacggucgcccacaccgggcagcacgaccuggugaucccgcccaacggcuacuuccgcuucgacagcugggugaaccaguucuacacccuggcccccauggggaacggcgcgggccggcgccgcgcccucuga

SEQ ID NO: 9152 - RNA, 1623 nt, Artificial Sequence
  derived and/or modified sequence opt1 from capsid_protein_VP1__Norovirus__BAI49910
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcaccaagcccuucuccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucgccggcacccagaacuacacgaugaaccuggccagccagaacuggaacaacuacgaccccaccgaggagaucccggcgccccuggggacccccgacuucgugggcaagauccaggggguccucacccagacgacccgccgggacggcuccacccgcgggcacaaggccaccgugagcacgggcagcgugcacuucacccccaagcugggcuccguccaguucagcaccgacaccuccaacgacuucgagacggggcagaacacccgguucaccccggugggcgugguccaggacgggagcaccacgcaccagaacgagccccagcagugggugcugcccaacuacuccggccgcgacagccacaacgugcaccucgcccccgccgucgccccgaccuuccccggggagcagcugcuguucuuccgguccaccaugcccggcugcagcggcuaccccaacaugaaccucgacugccugcugccgcaggagugggugcagcacuucuaccaggaguccgcccccgcgcagagcgacguggcccuccugcgcuucgucaaccccgacaccgggcgggugcuguucgagugcgagcuccacaaguccggcuacgugaccgucgcccacacggggcagcacgaccuggugaucccgcccaacggcuacuuccgcuucgacagcugggugaaccaguucuacacccuggcccccauggggaacggcgcgggccggcgccgcgcccucuga

SEQ ID NO: 9153 - RNA, 1623 nt, Artificial Sequence
  derived and/or modified sequence opt1 from capsid_protein_VP1__Norovirus__BAI49911
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcugcuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgacccgcggcgacgggcugacccggggccacaaggccaccgucuccacgggcagcguggacuucaccccgaagcuggggagcgugcaguucgccaccgacaccgacaacgacuucgagacgggccagaacacccgcuucacccccgucggggugauccaggacggcuccagcgcccaccggaacgagccccagcagugggugcuccccgacuacuccgggcgcaccguccacaacgugcaccuggccccggccguggcccccacguuccccggcgagcagcuccucuucuuccggagcaccaugcccggcugcuccggguacccgaacauggaccuggacugccugcucccccaggaguggguccagcacuucuaccaggaggcggcccccgcccagagcgacguggcccugcugcgcuucguggaccccgacaccggccggguccucuucgagugcaagcugcacaagaccggguacgugaccguggcgcacacgggccagcacgaccuggucaucccgcccaacggguacuuccgcuucgacuccugggugaaccaguucuacacccucgcccccaugggcaacggcgccgggcgccggcgcgcccuguga

SEQ ID NO: 9154 - RNA, 1623 nt, Artificial Sequence
  derived and/or modified sequence opt1 from capsid_protein_VP1__Norovirus__BAI49912
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggccgcauccaggggaugcucacccagacgaccaagggcgacggguccacccggggccacaaggccaccgucagcacgggcagcguggacuucaccccgaagcugggguccgugcaguucgccaccgacaccgacaacgacuucgagacgggccagaacacccgcuucacccccgucggggugauccaggacggcagcuccgcccugcggaacgagccccagcagugggugcuccccgacuacagcgggcgcaccguccacaacgugcaccuggccccggccguggcccugacguuccccggcgagcagcuccuguucuuccgguccaccaugcccggcugcagcggguaccccaacauggaccuggacugccuccugccgcaggaguggguccagcacuucuaccaggaggcggcccccucccagagcgacguggcccugcuccgcuucgugaaccccgacaccggccggguccuguucgagugcaagcugcaccgcgccggguacgugaccguggcgcacaccggccagcacgaccucgucaucccgcccaacggguacuuccgcuucgacuccugggugaaccaguucuacacgcuggcccccaugggcaacggcgccgggcggcgccgggcccuguga

SEQ ID NO: 9155 - RNA, 1623 nt, Artificial Sequence
  derived and/or modified sequence opt1 from capsid_protein_VP1__Norovirus__BAI49914
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgucagcacgggcagcguggacuucaccccgaagcugggguccgugcaguucgccaccgacaccgacaacgacuucgagacgggccagaacacccgguucacccccgucggggugauccaggacggcagcuccacccaccgcaacgagccccagcagugggugcugcccgacuacagcgggcggacgguccacaacgugcaccucgccccggccguggcccccaccuuccccggcgagcagcugcuguucuuccgcuccaccaugcccggcugcagcggguacccgaacauggaccucgacugccugcugccccaggaguggguccagcacuucuaccaggaggccgcgcccucccagagcgacguggcccuccugcgguucgugaaccccgacaccggccgcguccuguucgagugcaagcuccacaaggccggguacgugaccguggcccacacgggccagcacgaccuggucaucccgcccaacggguacuuccgguucgacuccugggugaaccaguucuacacccuggcgcccaugggcaacggcgccgggcgccgccgggcccucuga

SEQ ID NO: 9156 - RNA, 1623 nt, Artificial Sequence
  derived and/or modified sequence opt1 from capsid_protein_VP1__Norovirus__BAI49916
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcuccugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggccugcugacccagaccaccaagggggacggcagcacgcggggccacaaggccaccgucuacaccggguccgcccccuucaccccgaagcucggcggggugcaguucagcacggacaccgagaacgacuucgagacccaccagaacaccaaguucacgcccgugggcgucauccaggacgggagcaccacccaccgcaacgagccccagcagugggugcugcccuccuacagcggccggaacgugcacaacguccaccuggccccggccguggcgcccaccuuccccggcgagcagcuccuguucuuccgcuccacgaugcccgggugcagcggcuacccgaacauggaccuggacugccuccugccccaggagugggugcagcacuucuaccaggaggccgcccccgcccaguccgacgucgcgcugcuccgguucgugaaccccgacaccgggcgcgugcuguucgagugcaagcugcacaagagcggcuacgucaccguggcccacaccgggcagcacgaccucgugaucccgcccaacggcuacuuccgguucgacuccugggucaaccaguucuacacccuggcccccaugggcaacgggacgggccgccggcgcgcccuguga

SEQ ID NO: 9157 - RNA, 1623 nt, Artificial Sequence
  derived and/or modified sequence opt1 from capsid_protein_VP1__Norovirus__BAI49917
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggaggugaccaacucccgguuccccaucccccuggagaagcuguucaccggccccagcggggccuucgucgugcagccgcagaacggccgcugcacgaccgacgggguccugcugggcaccacccagcucucccccgugaacaucugcacguuccggggcgacgugacccacaucgccgggacccgcaacuacaccaugaaccuggccagccugaacuggaacaacuacgaccccacggaggagaucccggcgccccucggcacccccgacuucgucgggaagauccagggcgugcugacccagaccacgaagggggacggcuccacccggggccacaaggccaccguguacaccgggagcgcccccuucacgccgaagcugggcuccguccaguucagcaccgacaccgagaacgacuucgagacccaccagaacacgaaguucacccccgugggggugauccaggacggcgggaccacccaccgcaacgagccccagcaguggguccuccccagcuacuccggccggaacgugcacaacgugcaccuggccccggccgucgcgcccacguuccccggcgagcagcuccucuucuuccgcagcaccaugcccgggugcuccggcuacccgaacauggaccuggacugccugcucccccaggagugggugcagcacuucuaccaggaggccgcccccgcccagagcgacguggcgcugaugcgguucgucaaccccgacaccgggcgcgugcuguucgagugcaagcuccacaaguccggcuacgugaccgucgcccacaccgggcagcacgaccuggugaucccgcccaacggcuacuuccgguucgacagcugggugaaccaguucuacacgcuggcccccaugggcaacgggaccggccgccggcgcgcccucuga

SEQ ID NO: 9158 - RNA, 1623 nt, Artificial Sequence
  derived and/or modified sequence opt1 from capsid_protein_VP1__Norovirus__BAI49918
augaagauggccagcaacgacgccaaccccuccgacggcagcgcggccaaccuggugccggaggucaacaacgaggugauggcccucgagcccguggccggggccgcgaucgccgcccccgucgccggccagcagaacgugaucgaccccuggauccgcaacaacuucgugcaggcgcccgggggcgaguucaccgucagcccccggaacgcccccggggagauccugugguccgcgccccugggcccggaccucaaccccuaccugucccaccuggcccgcauguacaacggcuacgccgggggcuucgagguccaggugauccucgccgggaacgccuucaccgccggcaagaucaucuucgccgccgugccgcccaacuucccgacggaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgcgaugcucuacacgccccugcgggccaacaacgccggcgaggacgucuucaccgugagcugccgcgugcugacccggcccuccccggacuucgacuucaucuuccucgucccgcccaccguggagagccgcaccaagcccuucacggugcccauccugaccgucgaggagaugaccaacucccgguuccccaucccccuggagaagcuguucaccggccccagcggggccuucguggugcagccgcagaacggccgcugcacgaccgacgggguccugcugggcaccacccagcucucccccgugaacaucugcacguuccggggcgacgucacccacaucgccgggacccgcaacuacaccaugaaccuggcgagccugaacuggaacaacuacgaccccacggaggagaucccggcgccccucggcacccccgacuucguggggaagauccagggcgugcugacccagaccacgaagggggacggcuccacccggggccacaaggccaccgucuacaccgggagcgcccccuucacgccgaagcugggcuccgugcaguucagcaccgacaccgagaacgacuucgagacccaccagaacacgaaguucacccccgugggggucauccaggacggcgggaccacccaccgcaacgagccccagcagugggugcuccccagcuacuccggccggaacgugcacaacguccaccuggccccggccguggcccccacguuccccggcgagcagcuccucuucuuccgcagcaccaugcccgggugcuccggcuacccgaacauggaccuggacugccugcucccccaggagugggugcagcacuucuaccaggaggccgcccccgcgcagagcgacgucgcccugaugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacgcuggcccccaugggcaacgggaccggccgccggcgcgcccucuga

SEQ ID NO: 9159 - RNA, 1623 nt, Artificial Sequence
  derived and/or modified sequence opt1 from capsid_protein_VP1__Norovirus__BAI49919
augaagauggccagcaacgacgccaaccccuccgacggcagcgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugucccaccuggcccgcauguacaacggcuacgccgggggcuucgagguccaggugauccucgccgggaacgccuucaccgccggcaagaucaucuucgccgccgugccgcccaacuucccgacggaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgccaugcucuacacgccccugcgggcgaacaacgccggcgaggacgucuucaccgugagcugccgcgugcugacccggcccuccccggacuucgacuucaucuuccucgucccgcccaccguggagagccgcaccaagcccuucacggugcccauccugaccgucgaggagaugaccaacucccgguuccccaucccccuggagaagcuguucaccggccccagcggggccuucguggugcagccgcagaacggccgcugcacgaccgacgggguccugcugggcaccacccagcucucccccgugaacaucugcacguuccggggcgacgucacccacaucgccgggacccgcaacuacaccaugaaccuggccagccugaacuggaacaacuacgaccccacggaggagaucccggcgccccucggcacccccgacuucguggggaagauccagggcgugcugacccagaccacgaagggggacggcuccacccggggccacaaggccaccgucuacaccgggagcgcccccuucacgccgaagcugggcuccgugcaguucagcaccgacaccgagaacgacuucgagacccaccagaacacgaaguucacccccgugggggucauccaggacggcgggaccacccaccgcaacgagccccagcagugggugcuccccagcuacuccggccggaacgugcacaacguccaccuggccccggccguggcgcccacguuccccggcgagcagcuccucuucuuccgcagcaccaugcccgggugcuccggcuacccgaacauggaccuggacugccugcucccccaggagugggugcagcacuucuaccaggaggccgcccccgcccagagcgacgucgcgcugaugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacgcuggcccccaugggcaacgggaccggccgccggcgcgcccucuga

SEQ ID NO: 9160 - RNA, 1623 nt, Artificial Sequence
  derived and/or modified sequence opt1 from capsid_protein_VP1__Norovirus__BAI49920
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagcugaacgacagcaccaucaagcucaucgccaugcuguacacgccccugcgggcgaacaacgccggcgaggacguguucaccguguccugccgcguccucacccggcccagcccggacuucgacuucaucuuccuggugccgcccaccguggagucccgcaccaagcccuucacgguccccauccugaccguggaggagaugaccaacagccgguuccccaucccccucgagaagcuguucaccggccccuccggggccuucgugguccagccgcagaacggccgcugcacgaccgacggggugcugcucggcaccacccagcugagccccgucaacaucugcacguuccggggcgacgugacccacaucgccgggucccgcaacuacaccaugaaccuggccagccucaacuggaacaacuacgaccccaccgaggagaucccggcgccccugggcacgcccggguucgugggcaagauccaggggguccugacccagaccaccaagggcgacggcuccacgcgggggcacaaggccaccguguacaccggcagcgcccccuucaccccgaagcucggguccgugcaguucagcacggacaccgagaacgacuucgagacccaccagaacaccaaguucacgcccgucggcgugauccaggacgggagcaccacccaccgcaacgagccccagcagugggugcugcccuccuacagcggccggaacguccacaacgugcaccuggccccggccguggcgcccaccuuccccggcgagcagcuccuguucuuccgcuccacgaugcccgggugcagcggcuacccgaacauggaccuggacugccuccugccccaggaguggguccagcacuucuaccaggaggccgcccccgcccaguccgacguggcgcugcuccgguucgugaaccccgacaccgggcgcguccuguucgagugcaagcugcacaagagcggcuacgugaccguggcccacaccgggcagcacgaccucgucaucccgcccaacggcuacuuccgguucgacuccugggugaaccaguucuacacccuggcccccaugggcaacgggacgggccgccggcgcgcccuguga

SEQ ID NO: 9161 - RNA, 1623 nt, Artificial Sequence
  derived and/or modified sequence opt1 from capsid_protein_VP1__Norovirus__BAI49921
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucaucgacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgaggacgucuucaccguguccugccgcgugcugacccggcccagccucgacuucgacuucaucuuccuggucccgcccaccguggagucccgcaccaagcccuucacggugcccauccugaccgucgaggagaugaccaacagccgguucccgaucccccucgagaagcuguucaccggccccuccggggccuucguggugcagccccagaacggccgcugcacgaccgacgggguccugcucggcaccacccagcugagcccggugaacaucugcacgcugcggggcgacgucacccacaucgccgggucccgcaacuacaccaugaaccucgccagccugaacuggaacaacuacgaccccaccgaggagauccccgcgccgcugggcacgcccgacuucguggggaagauccagggcgugcucacccagaccaccaagggggacggcuccacgcggggccacaaggccaccgucuacaccgggagcgcccccuucacccccaagcugggcagcgugcaguucuccacggacaccgagaacgacuucgagacccaccagaacaccaaguucacgccggugggggucauccaggacggcagcaccacccaccgcaacgagccccagcagugggugcugcccuccuacagcgggcggaacgugcacaacguccaccucgcccccgccguggcgccgaccuuccccggcgagcagcugcuguucuuccgcuccacgaugcccggcugcagcggguaccccaacauggaccucgacugccugcugccgcaggagugggugcagcacuucuaccaggaggccgcccccgcccaguccgacgucgcgcuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacggcacggggcgccggcgcgcccucuga

SEQ ID NO: 9162 - RNA, 1623 nt, Artificial Sequence
  derived and/or modified sequence opt1 from capsid_protein_VP1__Norovirus__BAI49923
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcuccaccacccaccgcaacgagccccagcagugggugcuccccagcuacuccgggcggaacguccacaacgugcaccuggccccggccguggcgcccacguuccccggcgagcagcuccucuucuuccgcagcaccaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacgcucgcccccaugggcaacggcaccgggcgccggcgcgcccuguga

SEQ ID NO: 9163 - RNA, 1623 nt, Artificial Sequence
  derived and/or modified sequence opt1 from capsid_protein_VP1__Norovirus__BAI49924
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaucaugaaccuggccagccugaacuggaacaacuacgaccccaccgaggagaucccggcgccccucgggacccccgacuucgugggcaagauccaggggguccugacgcagaccaccaagggcgacggguccacccggggccacaaggccacgguguacaccggcagcgcccccuucaccccgaagcuggggagcgugcaguucuccaccgacacggagaacgacuucgagacccaccagaacacccgcuucacccccgucggcgugauccaggacgggggcacgacccaccggaacgagccccagcagugggugcuccccagcuacuccgggcgcaacgucccgaacgugcaccuggcccccgccguggcgcccaccuuccccggcgagcagcuccucuucuuccggagcaccaugccgggcugcuccggguaccccaacauggaccuggacugccugcucccccaggaguggguccagcacuucuaccaggaggccgcccccgcccagagcgacguggcgcugcugcgcuucgugaacccggacacgggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcaccgggcggcgccgcgugcuguga

SEQ ID NO: 9164 - RNA, 1623 nt, Artificial Sequence
  derived and/or modified sequence opt1 from capsid_protein_VP1__Norovirus__BAI49925
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccgguccgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacacccgcuucacgcccgucggcgugauccaggacgggggcaccacccaccggaacgagccccagcagugggugcuccccuccuacagcgggcgcaacgucccgaacgugcaccuggcccccgccguggcgcccaccuuccccggcgagcagcuccucuucuuccgguccacgaugccgggcugcagcggguaccccaacauggaccuggacugccugcucccccaggaguggguccagcacuucuaccaggaggccgcccccgcccaguccgacguggcgcugcugcgcuucgugaacccggacaccggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcacggggcggcgccgcgugcuguga

SEQ ID NO: 9165 - RNA, 1623 nt, Artificial Sequence
  derived and/or modified sequence opt1 from capsid_protein_VP1__Norovirus__BAI49926
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcuccugggcaccacccagcucucccccgucaacaucugcacguuccggggcgacgugacccacaucgccgggagccgcaacuacaccaugaaccugaccucccugaacuggaacaacuacgaccccacggaggagaucccggcgccccucggcacccccgacuucguggggaagauccagggccugcugacccagaccacgaagggggacggcagcacccggggccacaaggccaccgucuacaccggguccgcccccuucacgccgaagcucggcagcgugcaguucagcaccgacaccgagaacgacuucgagacccaccagaacacgaaguucacccccgugggggucauccaggacggcuccaccacccaccgcaacgagccccagcagugggugcugcccagcuacuccgggaucaacgugcacaacguccaccuggccccggccguggcccccacguuccccggcgagcagcuccuguucuuccggagcaccaugcccggcugcuccggguacccgaacauggaccuggacugccuccugccccaggagugggugcagcacuucuaccaggaggcggcccccgcccagagcgacgucgcccugcuccgcuucgugaaccccgacaccggccgggugcuguucgagugcaagcugcacaaguccggguacgucaccguggcgcacaccggccagcacgaccucgugaucccgcccaacggguacuuccgcuucgacagcugggucaaccaguucuacacgcuggcccccaugggcaacggcaccgggcggcgccgggcccuguga

SEQ ID NO: 9166 - RNA, 1623 nt, Artificial Sequence
  derived and/or modified sequence opt1 from capsid_protein_VP1__Norovirus__BAI49927
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccggaacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcgcccuguga

SEQ ID NO: 9167 - RNA, 1623 nt, Artificial Sequence
  derived and/or modified sequence opt1 from capsid_protein_VP1__Norovirus__BAI49928
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccugaucccccucgagaagcuguucacgggccccagcggggccuucgugguccagccccagaacggccgcugcaccaccgacggggugcugcucggcaccacgcagcuguccccggucaacaucugcaccuuccggggcgacgugacccacaucgccgggagccgcaacuacaccaugaaccuggccucccucaacuggaacaacuacgaccccacggaggagauccccgcgccgcugggcacccccgacuucguggggaagauccagggcguccugacccagaccacgaagggggacggcagcacccggggccacaaggccaccguguacaccggguccgcccccuucacgcccaagcucggcagcgugcaguucagcaccgacaccgagaacgacuucgagacccaccagaacacgaaguucaccccggucggggugauccaggacggcuccaccacccaccgcaacgagccccagcagugggugcugcccagcuacuccgggcggaacguccacaacgugcaccuggcccccgccguggcgccgacguuccccggcgagcagcuccuguucuuccgcagcaccaugcccggcugcuccggguaccccaacauggaccuggacugccuccugccgcaggaguggguccagcacuucuaccaggaggccgcccccgcccagagcgacguggcgcugcuccgguucgugaaccccgacaccggccgcguccuguucgagugcaagcugcacaaguccggguacgugaccguggcccacaccggccagcacgaccucgucaucccgcccaacggguacuuccgguucgacagcugggugaaccaguucuacacgcuggcccccaugggcaacggcaccgggcgccggcgcgcccuguga

SEQ ID NO: 9168 - RNA, 1620 nt, Artificial Sequence
  derived and/or modified sequence opt1 from capsid_protein_VP1__Norovirus__BAJ25070
augaagauggccagcuccgacgccgcgcccagcaacgacggcgccaccgggcuggugcccgagaucaacaccgagacgcucccccuggagcccgucgccggcgccgccaucgcggcccccgugaccgggcagaacaacaucaucgacccguggauccgcaacaacuucgugcaggcccccaacggcgaguucaccgucagcccccggaacucccccggggagauccugaugaaccucgagcugggcccggaccugaaccccuaccucgcccaccugucccgcauguacaacggcuacgccgggggcguggaggugcagguccugcucgccgggaacgccuucaccgccggcaagauccuguucgccgcggugccgcccaacuuccccguggacaugcugagccccgcccagaucacgaugcucccccaccugaucgucgacgugcggacccuggagcccaucaugaucccgcuccccgacgugcgcaacgucuucuaccacuacaacaaccagcccgcgccccggaugcgccugguggccaugcuguacaccccgcuccgguccaacgggagcggcgaggacguguucaccgucuccugccgcgugcugacgcggcccacccccgacuucgaguucaccuaccuggugcccccgagcgucgaguccaagaccaagcccuucagccuccccauccugacgaucggcgagcugaccaacucccgcuuccccgccccgaucgaccagcuguucaccagcaccaacaacgacguggugguccagccccagaacgggcggugcacgcuggacggcgagcugcaggggaccacccagcuccuguccaccgcgaucugcagcuaccgcggcacgaccuccaaccccaucgacgacugggacgaccaccuccuccaccugacccacccgaacggcgccaccuacgaccccacggaggacgugcccgcccccuucgggacccaggacuuccagggcauccuguacgggaugcucacccagaacccgcagaccggcgggggcgaggccgccaacagccggggcguguacaucuccagcacgagcgacaaguucacccccaagcuggggaccaucggccugcaccacguccagggcggggacguggcgaacaaccagaaguccaaguucacccccaucgggaucgccgagaacggcaacacgcccuuccgccaguggguccucccgaacuacagcggccggcugacccugaacaccaaccucgcccccgccguggggcccaacuuccccggcgagcagauccuguucuuccgcuccaacgugccgagcguccagggcgggcacuccaucgagaucgacugccugaucccccaggaguggaucagccacuucuaccaggaguccgcccccagccaguccgacguggcgcucauccgguacgugaaccccgacaccgggcgcacgcuguucgaggccaagcugcaccggcagggcuucaucaccaucgccaccaccggcaacaacccggucguggugccgcccaacggguacuuccgcuucgacagcugggucaaccaguucuacgcccucgcgcccaugggcaccgggaacggccggcgccgcgugcaguga

SEQ ID NO: 9169 - RNA, 1620 nt, Artificial Sequence
  derived and/or modified sequence opt1 from capsid_protein_VP1__Norovirus__BAJ25072
augaagauggccagcaacgacgccgcgcccuccaacgacggcgccaccgggcuggugcccgagaucaacaccgagacgcucccccuggagcccgucgccggcgccgccaucgcggcccccgugaccgggcagaacaacaucaucgacccguggauccgcaccaacuucgugcaggcccccaacggcgaguucaccgucagcccccggaacucccccggggagauccugaugaaccucgagcugggcccggaccugaaccccuaccucgcccaccuggcgcgcauguacaacggcuacgccgggggcguggaggugcagguccugcucgccgggaacgccuucacggccggcaagauccuguucgcggccgugccgcccaacuuccccguggacaugcugagccccgcccagaucaccaugcucccccaccugaucgucgacgugcggacccuggagcccaucaugaucccgcuccccgacgugcgcaacgucuucuaccacuacaacaaccagcccgcgccccggaugcgccugguggccaugcuguacaccccgcuccgguccaacgggagcggcgaggacguguucacggucuccugccgcgugcugacccggcccacccccgacuucgaguucaccuaccuggugcccccgagcgucgaguccaagacgaagcccuucagccuccccauccugaccaucggcgagcugaccaacucccgcuuccccgccccgaucgaccagcuguucaccagcacgaacaacgacguggugguccagccccagaacgggcggugcacccuggacggcgagcugcaggggaccacccagcuccuguccacggccgugugcagcuaccgcggcaccaccuccaaccccaucgacgacugggacgaccaccuccuccaccugacccacccgaacggcgccacguacgaccccaccgaggacgugcccgcccccuucgggacccaggacuuccagggcauccuguacgggaugcucacccagaacccgcaggccggcgggggcgaggcggccagcucccggggcgucuacaucagcuccacgagcgacaaguucacccccaagcuggggaccaucggccugcaccgcgugcagggcggggccgucgccgacaaccagaaguccaaguucacccccaucgggaucgccgagaacgacaacacgcccuuccggcagugggugcucccgaacuacagcggccgccugacccugaacaccaaccucgcgcccgccgugggccccaacuuccccggggagcagauccuguucuuccggagcaacgucccguccgugcagggcgggcacagcaucgagaucgacugccugaucccccaggagugggugucccacuucuaccaggagagcgcccccucccagagcgacgucgcccucauccgcuacgugaaccccgacaccggccggacgcuguucgaggcgaagcugcaccgccagggguucaucaccaucgccaccaccggcaacaacccgguggucgugccgcccaacggcuacuuccgguucgacuccugggugaaccaguucuacgcccucgcccccauggggaccggcaacgggcgccgccggguccaguga

SEQ ID NO: 9170 - RNA, 1608 nt, Artificial Sequence
  derived and/or modified sequence opt1 from capsid_protein_VP1__Norovirus__BAJ25076
augaagauggccagcaacgacgccaaccccuccagcgacggcuccgcgaaccuggugccggagaucagcaacgaggucauggcccucgagcccguggccggggccgccaucgcggcccccguggccggccagcagaacaucaucgaccccuggauccgcaacaacuucguccaggcccccgggggcgaguucaccgugagcccccggaacgcgcccggggaggugcugcugaaccucccccuguccccggacaucaaccccuaccuggcccaccucucccgcauguacaacggcuacgccggcggggucgagguggaggugguccuggccggcaacgccuucaccgcggggaagaucaucuucgccgccgugccgcccaacuucccgcccgagaaccugagccccucccagaucacgaugcucccccacaucaucguggacguccggcagcuggagccggugcgcaucccccugcccgacgugcggaacaacuucuaccacuacagccgcgagaacgacuccacccuccggcugaucgccaugcuguacacgccccuccgcgccaacaacgcgggcgacgacgucuucaccgugagcugccgggugcugacccgcccgucccccgacuucgacuucaucuuccuggucccgcccaccguggagagcaaguccaagcccuucaccauccccaugcucaccaucgaggagaugacgaacagccgguuccccgcgccccuggagcugaugaccaccgggccgucccacgacaucgugguccagccccagaacggccgcugcaccaucgacggcgugcuccuggggacgacccagcugagccccgugaacaucugcucccuccggggcgucccgaccaagcgcaccaacgggaacgacaacugcuucgugcagcuggagaaccccaacggcagcgccuacgaccccacggaggacauccccgccguccugggcagcccggacuucgugggggagcucuacggcaccaucacccagcgguccagcgacaacuccacccgcgcccaccccuucacgcugaacaccgggagcccccgguacacccccaagaucggcuccguggacauccgcgucaccgacgugagcgaccugcaggaccacgacccggugaagcucacgcccgucgggcuguccggcgaccggggcagcauccaccaguggcagcugcccaacuacuccgggguggccacccacaacaugcaccucgcccccagcguggccccgcuguuccccggcgagcagauccuguucuuccgcuccaccguccccgggugcggcggguaccccaacagcaacaucgacugccucaucccgcaggagugggugcagcacuucuaccaggagggcgcccccgcccggaccgacguggcgcugcugcgcuucaucaaccccgacacgggccgcguccucuucgagugcaagcugcacaagcacggguucaucaccguggccuacuccggcaaccacgaccuggugaugcccccgaacggguacuuccgguucgagagcugggucaaccaguuccacacccucgcccccaugggcaccggguccggccgccggcgcauccaguga

SEQ ID NO: 9171 - RNA, 1644 nt, Artificial Sequence
  derived and/or modified sequence opt1 from capsid_protein_VP1__Norovirus__BAN16283
augaagauggccagcuccgacgccgcgcccagcaacgacggcgccgccaaccuggugccggaggccaacaacgaggucauggcccucgagcccguggugggggcguccaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucagccaccugucccgcauguacaacggcuacgcgggcgggaugcagguccagguggugcuggccggcaacgccuucaccgccgggaagaucaucuucgccgcggugccgccccacuuccccguggagaacaucagcgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacuccggcgaggacguguucaccgucagcugccgggugcugacccgccccgcgcccgacuucgaguucaccuuccuggugccgcccaccgucgaguccaagaccaagcccuucacgcuccccauccugacccugggggagcucagcaacucccgguucccggcccccaucgacaugcuguacaccgaccccaacgagggcaucguggugcagccccagaacggccgcugcacccuggacgggacgcuccagggcaccacccagcuggucccgacccagaucugcgccuuccgggggacgcugaucggccagaccagccgcuccagcgacuccaccgacagcgcgccccggcgccgggaccacccccuccacgugcagcugaagaaccuggacggcacccaguacgacccgacggacgagguccccgccgugcucggggccaucgacuucaagggcaccguguucggggucgccucccagcgcgacgugagcggcgaccaggugggggccacccgggcccacgagguccacaucaacaccacggacccccgcuacacccccaagcugggcagcauccugaugcacuccgagagcggcgacuucgugaccgggcagccggugcgguucacccccaucggcaugggggacaacgacuggcaccagugggagcuccccgacuacuccggccaccugacgcugaacaugaaccucgcccccgcggucgccccggccuuccccggggagcgcauccuguucuuccgcagcaucgugcccuccgccggcggcuacgggaccggccagaucgacugccugaucccccaggagugggugcagcacuucuaccaggaggcggccccgagccaguccgccgucgcccucauccgguacgugaaccccgacaccgggcgcaacaucuucgaggccaagcugcaccgggagggcuucaucaccguggcgaacagcgggaacaaccccaucgucgugcccccgaacggcuacuuccgcuucgaggccugggugaaccaguucuacacgcugacccccaugggcaccgggcagggccggcgccggaaccaguga

SEQ ID NO: 9172 - RNA, 1644 nt, Artificial Sequence
  derived and/or modified sequence opt1 from capsid_protein_VP1__Norovirus__BAN16285
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagggcaucguggugcagccccagaacggccgcugcacccuggacgggacgcuccagggcaccacccagcuggucccgacccagaucugcgccuuccgggggacgcugaucggccagaccucccgcagcuccgacagcaccgacuccgcgccccggcgccgggaccacccccuccacgugcagcugaagaaccuggacggcacccaguacgacccgacggacgagguccccgccgugcucggggccaucgacuucaagggcaccguguucggggucgccagccagcgcgacguguccggccagcaggucggggccacccgggcccacgaggugcacaucaacaccacggacccccgcuacacccccaagcugggcagcauccugaugcacagcgaguccgacgacuucgugaccggccagccggugcgguucacccccaucgggaugggcgacaacgacuggcaccagugggagcuccccgacuacagcgggcaccugacgcugaacaugaaccucgcccccgcggucgccccggccuuccccggcgagcgcauccuguucuuccgcuccauggugcccagcgccgggggcuacggcuccgggcagaucgacugccugaucccccaggagugggugcagcacuucuaccaggaggcggccccgagccaguccgccgucgcccucauccgguacgugaaccccgacaccggccgcaacaucuucgaggccaagcugcaccgggagggguucaucaccguggcgaacagcggcaacaaccccaucgucgugcccccgaacggguacuuccgcuucgaggccugggugaaccaguucuacacccugacgcccaugggcaccggccaggggcggcgccggaaccaguga

SEQ ID NO: 9173 - RNA, 1644 nt, Artificial Sequence
  derived and/or modified sequence opt1 from capsid_protein_VP1__Norovirus__BAN16287
augaagauggccagcaacgacgccgcgcccuccaacgacggcgccgccaaccuggugccggaggccaacaacgaggucauggcccucgagcccguggcgggggccagcaucgccgcccccguggucggccagcagaacaucaucgaccccuggauccgcgagaacuucgugcaggcgccgcagggggaguucaccgugagcccccggaacucccccggcgagaugcugcugaaccucgagcuggggcccgagcugaacccguaccucucccaccugagccgcauguacaacggcuacgccggcgggaugcagguccagguggugcuggccggcaacgccuucaccgccgggaagaucaucuucgcggccgucccgccccacuuccccgugaagaacaucuccgccgcccagaucacgaugugcccccacgugaucgucgacgugcggcagcucgagcccgugcugcugccccuccccgacauccgcaaccgguucuuccacuacaaccaggagaacaccccgcgcaugcggcuggucgccaugcuguacacgccccuccgcgcgaacagcggcgaggacguguucaccguguccugccggguccugacccgccccgcccccgacuucgaguucaccuuccuggugccgcccaccguggagagcaagaccaagcccuucacgcuccccauccugacccugggggagcucuccaacagccgguucccggcccccaucgacaugcuguacaccgaccccaacgagggcaucgucgugcagccccagaacggccgcugcacccuggacgggacgcuccagggcaccacccagcuggugccgacccagaucugcgccuuccgggggacgcugaucggccagaccucccgcagcuccgacagcaccgacuccgcgccccggcgccgggaccacccccuccacguccagcugaagaaccuggacggcacccaguacgacccgacggacgaggugcccgcgguccucggggccaucgacuucaagggcaccguguucgggguggccagccagcgcgacgucuccggccagcaggucggggccacccgggcccacgaggugcacaucaacaccacggacccccgcuacacccccaagcugggcagcauccugauccacagcgaguccgacgacuucgugaccggccagccggugcgguucacccccaucgggaugggcgacaacgacuggcaccagugggagcuccccgacuacagcgggcaccugacgcugaacaugaaccucgcgcccgccguggccccggccuuccccggcgagcgcauccuguucuuccgcuccaugguccccagcgccgggggcuacggcuccgggcagaucgacugccugaucccccaggagugggugcagcacuucuaccaggaggccgccccgagccaguccgccguggcccucauccgguacgucaaccccgacaccggccgcaacaucuucgaggcgaagcugcaccgggagggguucaucaccguggccaacagcggcaacaaccccaucguggucccccacaacggguacuuccgcuucgaggccugggugaaccaguucuacacccugacgccgaugggcaccggccaggggcggcgccggaaccaguga

SEQ ID NO: 9174 - RNA, 1644 nt, Artificial Sequence
  derived and/or modified sequence opt1 from capsid_protein_VP1__Norovirus__BAN16289
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagggcaucguggugcagccccagaacggccgcugcacccuggacgggacgcuccagggcaccacccagcuggucccgacccagaucugcgccuuccgggggacgcugaucggccagaccucccgcagcuccgacagcaccgacuccgcgccccggcgccgggaccacccccuccacgugcagcugaagaaccuggacggcacccaguacgacccgacggacgagguccccgccgugcucggggccaucgacuucaagggcaccgugcugggggucgccagccagcgcgacguguccggccagcaggucggggccacccgggcccacgaggugcacaucaacaccacggacccccgcuacacccccaagcugggcagcauccucaugcacagcgaguccgacgacuucgugaccggccagccggugcgguucacccccaucgggaugggcgacaacgacuggcaccagugggagcugcccgacuacagcgggcaccugacgcucaacaugaaccuggcccccgcggucgccccggccuuccccggcgagcgcauccuguucuuccgcuccaucgugcccagcgccgggggcuacggcuccgggcagaucgacugccucaucccccaggagugggugcagcacuucuaccaggaggcggccccgagccaguccgccgucgcccugauccgguacgugaaccccgacaccggccgcaacaucuucgaggccaagcugcaccgggagggguucaucaccguggcgaacagcggcaacaaccccaucgucgugcccccgaacggguacuuccgcuucgaggccugggugaaccaguucuacacccucacgcccaugggcaccggccaggggcggcgccggaaccaguga

SEQ ID NO: 9175 - RNA, 1644 nt, Artificial Sequence
  derived and/or modified sequence opt1 from capsid_protein_VP1__Norovirus__BAN16291
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggaggacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagaccaucguggugcagccccagaacggccgcugcacgcuggacggcacccuccaggggaccacccagcuggucccgacgcagaucugcuccuuccggggcacccugaucagccagaccucccgcagcgccgacuccaccgacagcgcgccccgggugcgcaaccacccccuccacguccagaugaagaaccuggacgggacgccguacgaccccaccgacgaggugcccgccgugcugggcgcgaucgacuucaagggcaccgucuucgggguggccucccagcggaacaccacgggcaacagcgugggggccacccgcgcccacgagguccacaucgacaccaccaacccccgguacacgccgaagcucggcagcgugcugaugaacuccgagagcuccgacuucgacgacgggcagcccauccgcuucacccccaucggcaugggcgccgacgacuggcaccagugggagcugcccgaguacagcgggcaccucacccugaacaugaaccuggcgccggccguggcccccgccuuccccggcgagcggauccucuucuuccgcuccgucgugcccagcgccgggggcuacggguccggccagaucgacugccugaucccgcaggagugggugcagcacuucuaccaggaggccgcccccagccaguccgccgucgcccugauccgcuacgugaaccccgacaccggccggaacaucuucgaggcgaagcuccaccgcgagggguucaucacgguggccaacagcggcaacaaccccaucgucgugccgcccaacggguacuuccgguucgaggccugggugaaccaguucuacacccugacccccaugggcaccgggcagggccgccggcgcguccaguga

SEQ ID NO: 9176 - RNA, 1644 nt, Artificial Sequence
  derived and/or modified sequence opt1 from capsid_protein_VP1__Norovirus__BAN16293
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggaggacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagaccaucguggugcagccccagaacggccgcugcacgcuggacggcacccuccaggggaccacccagcuggucccgacgcagaucugcuccuuccggggcacccugaucagccagaccucccgcagcgccgacuccaccgacagcgcgccccgggugcgcaaccacccccuccacguccagcugaagaaccuggacgggacgccguacgaccccaccgacgaggugcccgccgugcucggcgcgaucgacuucaagggcaccgucuucgggguggccucccagcggaacaccacgggcaacagcgugggggccacccgcgcccacgagguccacaucgacaccaccaacccccgguacacgccgaagcugggcagcgugcugaugaacuccgagagcuccgacuucgacgacgggcagcccauccgcuucacccccaucggcaugggcgccgacgacuggcaccagugggagcuccccgaguacagcgggcaccugacccugaacaugaaccucgcgccggccguggcccccgccuuccccggcgagcggauccuguucuuccgcuccgucgugcccagcgccgggggcuacggguccggccagaucgacugccugaucccgcaggagugggugcagcacuucuaccaggaggccgcccccagccaguccgccgucgcccucauccgcuacgugaaccccgacaccggccggaacaucuucgaggcgaagcugcaccgcgagggguucaucacgguggccaacagcggcaacaaccccaucgucgugccgcccaacggguacuuccgguucgaggccugggugaaccaguucuacacccugacccccaugggcaccgggcagggccgccggcgcguccaguga

SEQ ID NO: 9177 - RNA, 1644 nt, Artificial Sequence
  derived and/or modified sequence opt1 from capsid_protein_VP1__Norovirus__BAN16295
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccaggaggugcuggccggcaacgccuucaccgccgggaagaucaucuucgccgcggugccgccccacuuccccguggagaacaucuccgccgcccagaucacgaugugcccccacgugaucgucgacgugcggcagcucgagcccgugcugcugccccuccccgacauccgcaaccgguucuuccacuacaaccaggaggacaccccgcgcaugcggcuggucgccaugcuguacacgccccuccgcgccaacagcggcgaggacguguucaccguguccugccggguccugacccgccccgcgcccgacuucgaguucaccuuccuggugccgcccaccguggagagcaagaccaagcccuucacgcuccccauccugacccugggggagcucuccaacagccgguucccggcccccaucgacaugcuguacaccgaccccaacgagaccaucgucgugcagccccagaacggccgcugcacgcuggacggcacccuccaggggaccacccagcuggugccgacgcagaucugcuccuuccggggcacccugaucagccagaccucccgcagcgccgacuccaccgacagcgcgccccggguccgcaaccacccccuccacgugcagcugaagaaccuggacgggacgccguacgaccccaccgacgagguccccgccgugcucggcgcgaucgacuucaagggcaccguguucggggucgccucccagcggaacaccacgggcagcagcgugggggccacccgcgcccacgaggugcacaucgacaccaccaacccccgguacacgccgaagcugggcuccguccugaugcacagcgaguccagcgacuucgacgacgggcagcccacccgcuucacccccaucggcaugggcgccgacgacuggcggcagugggagcuccccgaguacuccgggcaccugacccugaacaugaaccucgcgccggccguggcccccgccuuccccggcgagcgcauccuguucuuccgcagcgugguccccuccgccgggggcuacgggagcggccagaucgacugccugaucccgcaggagugggugcagcacuucuaccaggaggccgcccccucccagagcgccguggcccucauccgguacgucaaccccgacacgggccgcaacaucuucgaggcgaagcugcaccgggagggguucaucaccguggccaacuccggcaacaaccccaucguggucccgcccaacggguacuuccgcuucgaggccugggugaaccaguucuacacccugacccccaugggcacggggcagggccggcgccgggugcaguga

SEQ ID NO: 9178 - RNA, 1653 nt, Artificial Sequence
  derived and/or modified sequence opt1 from capsid_protein_VP1__Norovirus__BAN16297
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggacaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccgugcugacccugggggagcucuccaacagccgguucccggccgccaucgacaugcuguacaccgaccccaacgaguccaucgugguccagccccagaacggccgcugcacccuggacggcacgcuccaggggaccacccagcuggugcccacccagaucugcgccuuccggggcacgcugaucagccagaccgcccgcgcggccgacuccgucgacagcccgcagcgggcccgcgaccacccccuccacguccaggugaagaaccuggacgggacccaguacgaccccaccgacgacaucccggccgugcugggcgccaucgacuucaagggcacgguguucgggguggcgucccagcgggacgucagcggcacccaggagcaggggcacuacgccacccgcgcccacgaggcccacaucgacaccacggaccccaaguacgcgcccaagcucggcaccauccugaucaaguccgacagcaacgacuucaacaccaaccagcccauccgguucaccccgguggggaugggcgacaacaacuggcgccagugggagcugcccgacuacagcggccggcucacgcugaacaugaaccuggcccccgccgugucccccagcuucccgggggagcgcauccucuucuuccgcuccaucguccccagcgccggcggguacggcuccggguacaucgacugccugaucccccaggagugggugcagcacuucuaccaggaggccgcgcccagccaguccgccguggcccugguccgguacgugaacccggacaccggccgcaacaucuucgaggccaagcuccaccgggagggcuuccugaccguggccaacagcgggaacaaccccaucgucgugccgcccaacggcuacuuccgcuucgaggcgugggugaaccaguucuacacccuggcccccaugggguccggccaggggcggcgccgggcccaguga

SEQ ID NO: 9179 - RNA, 1623 nt, Artificial Sequence
  derived and/or modified sequence opt1 from capsid_protein_VP1__Norovirus__BAR42289
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccgaccggcaucugcgcguuccgcggccgggucaccgcccagaucaaccagcgcgaccgguggcacaugcagcugcagaaccucaacgggacgaccuacgaccccaccgacgacgugcccgccccgcugggcacccccgacuucaaggggguggucuucggcauggugucccagcgcaacgucgggaacgacgcccccggcagcacgcgggcccagcaggcguggguguccaccuacagcccccaguucgugccgaagcugggcagcgucaaccuccgcaucuccgacaacgacgacuuccaguuccagcccaccaaguucacccccgugggggugaacgacgacgacgacggccaccccuuccggcagugggagcugccgaacuacagcggggagcugacgcucaacaugaaccuggccccgcccgucgcccccaacuuccccggcgagcagcuccuguucuuccgcuccuucgugcccugcagcgggggcuacaaccagggcaucaucgacugccugaucccccaggaguggauccagcacuucuaccaggaguccgcccccagccaguccgacguggcccugauccgguacgucaacccggacaccgggcgcacccucuucgaggcgaagcugcaccgcagcggcuacaucaccguggcccacuccggggacuacccccuggugguccccgccaacggccacuuccgguucgacagcugggugaaccaguucuacucccucgcccccauggggacgggcaacggccgccggcgcgcgcaguga

SEQ ID NO: 9180 - RNA, 1617 nt, Artificial Sequence
  derived and/or modified sequence opt1 from capsid_protein_VP1__Norovirus__BAR47616
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacaacaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugccgagcggcaucugcgcguuccgcggccgggucaccgccgagaccgaccaccgcgacaaguggcacaugcagcugcagaaccucaacgggacgaccuacgaccccaccgacgacgugcccgccccgcugggcacccccgacuucaaggggguggucuucggcguggccucccagcggaacgucgggaacgacgcccccggcagcacgcgcgcgcacgaggccgugaucuccaccuacagcccccaguucgugccgaagcugggcagcgucaacuuccgguccaacgacaacgacuuccagcuccagcccaccaaguucacccccguggggaucaacgacgacggcgaccaccccuuccgccagugggagcugccggacuacagcgggcugcucacgcugaacaugaaccuggccccgcccguggcccccaacuuccccggcgagcagcuccuguucuuccgguccuucguccccugcagcgggggcuacaaccagggcaucguggacugccugaucccccaggaguggauccagcacuucuaccaggaguccgcccccagccaguccgacguggcgcucauccgcuacgucaacccggacaccgggcggacccuguucgaggccaagcugcaccgcagcggcuacaucaccguggcccacuccggggacuacccccucgugguccccgccaacggcuacuuccgcuucgacagcugggugaaccaguucuacucccuggcgcccauggggacgggcaacggccggcgccgggcccaguga

SEQ ID NO: 9181 - RNA, 1617 nt, Artificial Sequence; identical to SEQ ID NO: 9180
  derived and/or modified sequence opt1 from capsid_protein_VP1__Norovirus__BAR63715

SEQ ID NO: 9182 - RNA, 1617 nt, Artificial Sequence; identical to SEQ ID NO: 9180
  derived and/or modified sequence opt1 from capsid_protein_VP1__Norovirus__BAR63718

SEQ ID NO: 9183 - RNA, 1617 nt, Artificial Sequence; identical to SEQ ID NO: 9180
  derived and/or modified sequence opt1 from capsid_protein_VP1__Norovirus__BAR63721

SEQ ID NO: 9184 - RNA, 1623 nt, Artificial Sequence
  derived and/or modified sequence opt1 from capsid_protein_VP1__Norovirus__BAS02083
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaccaccggcagccacaacuacaccaugaaccuggccucccagaacuggagcaacuacgacccgacggaggagauccccgcgccccuggggacccccgacuucgugggcaagauccaggggguccucacccagaccacgcgcaccgacggcagcacccgggggcacaaggccaccguguacacgggcuccgccgacuucgccccgaagcugggccgcgugcaguucgagaccgacaccaaccacgacuucgaggccaaccagaacaccaaguucacgcccgucggggugauccaggacggcgggaccacccaccggaacgagccccagcagugggugcugcccagcuacuccggccgcaacaccccgaacguccaccucgcccccgcgguggcccccacguuccccggggagcagcugcuguucuuccggagcaccaugccgggcugcuccggcuaccccaacauggaccucgacugccugcugccccaggagugggugcaguacuucuaccaggaggccgcccccgcgcagagcgacgucgcccuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacgcuggcccccauggggaacggcaccggccggcgccgcgcccucuga

SEQ ID NO: 9185 - RNA, 1635 nt, Artificial Sequence
  derived and/or modified sequence opt1 from capsid_protein_VP1__Norovirus__CRL46952
augaugauggccagcaaggacgccacccccuccgcggacggcgccaccggggccggccagcuggugccggaggucaacacggccgaccccauccccaucgaccccguggccgggagcuccaccgcgcucgccaccgccggccaggugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcgcguccggguggugcuggccgggaacgccuucaccgccggcaaggucaucaucugcugcgugccgcccggguuccagucccgcacccucagcaucgcccaggccacccuguucccccacgugaucgcggacguccggacgcuggaccccguggaggugccccucgaggacguccgcaacgugcuguaccacaacaacgacacccagcccaccaugcggcugcucugcaugcuguacaccccgcugcgcacgggcggcgccuccgggggcaccgacagcuucguggucgccgggcgggugcugaccugccccggccccgacuucaacuuccucuuccuggugcccccgaccgucgagcagaagacgcgccccuucaccgugcccaacaucccccucaaguaccuguccaacagccggaucccgaaccccaucgagggcaugucccugagccccgaccagacccagaacgugcaguuccagaacgggcgcugcaccaucgacggccagccccucgggacgaccccggucuccgugagccagcugugcaaguuccggggccgcaucaccuccgggcagcggguccugaaccucaccgagcuggacggcagccccuucauggccuucgccgcgcccgccccggccggcuuccccgaccugggguccugcgacuggcacaucgagaugagcaagauccccaacagcuccacgcagaacaaccccaucguggugaacagcgucaagccgaacucccagcaguucgugccccaccucagcuccaucacccuggacgacaucgugagcuccggcggggacuacaucggcaccauccaguggaccagcccgcccuccgacagcgggggcgccaacacgaacuucuggaagauccccgacuacggcuccagccuguccgaggccagccagcucgcgcccgccgucuacccgcccggguucaacgaggugaucguguacuucauggccuccauccccggccccaaccagagcgggucccccaaccugguccccugccugcucccgcaggaguacaucacccacuucaucagcgagcaggcccccauccagggcgaggccgcgcugcugcacuacguggaccccgacaccaaccgcaaccucggggaguucaagcuguaccccggcggcuaccugaccugcgugccgaacuccagcagcacggggccccagcagcucccccuggacggcgucuucguguucgccuccugggugagccgguucuaccagcugaagcccgucgggaccgccggcccggcccgcggccggcucggggugcgccgguga

SEQ ID NO: 9186 - RNA, 1623 nt, Artificial Sequence
  derived and/or modified sequence opt1 from capsid_protein_VP1__Norovirus__CRL46955
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgauccagggcauguucaugucccccgacgucaaccagagcgugcaguuccagaacgggcgcugccagaucgacggccagcugcaggggaccacccccgugucccucagccagcugugcaagauccggggcaagacguccagcaacgcccgcguccugaaccucagcgagguggacgggacccccuucaucccgcuggagucccccgcccccgucggcuucccggaccugggcgggugcgacuggcacgugaacuucaccuuccaggcgcagaaccaggaccccagccaguccgugaccuucgccacgaacgacgccagcuucguccccuaccucggcuccaucagcccccacaacgggggcgacuuccacgccggggacaucaucggcucccugggcuggaucagcgccccguccgacaacagccagcugaacguguggaccauccccaaguacggguccagccuccccgacgugacccaccuggcgcccgccgucuucccgcccggcuucggggaggugauccuguacuucuacuccaccuuccccggcagcgggcagcccucccagcuccaggugccgugccugcugccccaggaguucaucacgcacuucugcaacgagcaggcccccaucgccggcgaggcggcccuccugcacuacgucgaccccgacaccggccggaaccugggggaguucaagcucuacccggacggcuucaugaccugcgugcccaacagcguguccagcgggccccagacccugcccaucaacggcgucuucguguucguguccugggucagccgcuucuaccagcugaagccggugggcacggccagcgccgcccggcgccucgggcugcggcgcaucuga

SEQ ID NO: 9187 - RNA, 1623 nt, Artificial Sequence
  derived and/or modified sequence opt1 from capsid_protein_VP1__Norovirus__CRL46958
augaagauggccagcaacgacgccaaccccuccgacggcagcgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugucccaccuggcccgcauguacaacggcuacgccgggggcuucgagguccaggugauccucgccgggaacgccuucaccgccggcaagaucaucuucgccgccgugccgcccaacuucccgacggaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgccaugcucuacacgccccugcgggcgaacaacgccggcgacgacgucuucaccgugagcugccgcgugcugacccggcccuccccggacuucgacuucaucuuccucgucccgcccaccguggagagccgcaccaagcccuucacgauccccauccugaccguggaggagaugaccaacucccgguuccccaucccccuggagaagcucuacaccggccccagcuccgccuucgucgugcagccgcagaacgggcgcugcacgaccgacggcgugcugcuggggaccacccagcucagccccgucaacaucugcacguuccggggcgacgugaccaacauccagggcucccacaccuacaccaugaaccuggccagccugaacuggaacaacuacgaccccacggaggagaccccggcgccccucgggacccccgacuucgucggcaagauccagggggugcugacccagacgaccaagggccagggguccacccgcggccacaaggccaccguguacacgggcagcgccagcuucacccccaagcugggguccguccaguuccggaccgacacccagaacgacuucgugacgcaccagaacaccaaguucaccccggugggcgucauccaggacggggacaccacgcaccgcaacgagccccagcagugggugcuccccaacuacagcggcgugaacacccacaacguccaccuggcccccgccguggccccgaccauccccggggagcagcuccuguucuuccgguccagcaugcccggcugcuccggcuaccccaacauggaccuggacugccuggugccgcaggaguggguccagcacuucuaccaggaggcggcccccgcccucagcgacguggcccugcugcgcuucgugaaccccgacaccgggcggguccucuucgagugcaagcugcacaaguccggcuacgugaccguggcgcacacggggcaccacgaccuggucaucccgcccaacggcuacuuccgcuucgacagcugggugaaccaguucuacacccucgcccccauggggaacggcaccggccggcgccgggugcuguga

SEQ ID NO: 9188 - RNA, 1623 nt, Artificial Sequence
  derived and/or modified sequence opt1 from capsid_protein_VP1__Norovirus__CRL46961
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugucccacaucacgggcagccgcaacuacaccaugaaccuggccagccagaacuggaacaacuacgaccccaccgaggagaucccggcgccccuggggacccccgacuucgucggcaagauccaggggaugcucacgcagaccacccgggccgacggcuccacccgcgggcacaaggccacgguguacaccggcagcgccgacuucgcccccaagcugggccgggugcaguucgagaccgacaccgaccacgacuucgaggccaaccagaacacgaaguucaccccggucggggugauccaggacggcuccaccacccaccgcaacgagccccagcagugggugcugcccagcuacuccgggcggaacacgcacaacguccaccucgcgcccgccguggccccgaccuuccccggcgagcagcugcuguucuuccgcagcaccaugcccgggugcuccggcuaccccaacauggaccucgacugccugcugccgcaggagugggugcaguacuucuaccaggaggccgcgcccgcccagagcgacgucgcccuccugcgguucgugaaccccgacaccggccgcgugcuguucgagugcaagcuccacaaguccggguacgucacgguggcccacaccggccagcacgaccuggugaucccgcccaacggguacuuccgguucgacagcugggucaaccaguucuacacccuggcccccaugggcaacgggaccggccgccgccgggcgguguga

SEQ ID NO: 9189 - RNA, 1623 nt, Artificial Sequence
  derived and/or modified sequence opt1 from capsid_protein_VP1__Norovirus__CRL46964
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgacuucgucgugcagccccagaacgggcgcugcaccacggacggcgugcuccuggggaccacccagcucucccccgucaacaucugcaccuuccggggcgacgugacgcacaccaccggcagccgcaacuacaccaugaaccuggccucccagaacuggaacaacuacgacccgacggaggagacccccgcgccccuggggacccccgacuucgugggcaagauccgggggaugcucacccagacgacccgcgccgacggcagcacccgggggcacaaggccaccgucuacacgggcagcgccgacuucgccccgaagcugggccgcgugcaguucgagaccgacaccgacaacgacuucgacgccaaccagaacaccaaguucacgcccgugggggucauccaggacggcaccaccacccaccggaacgagccccgccagugggugcugcccuccuacagcgggcggaacacgcacaacgugcaccucgccccggcggucgcccccaccuuccccggcgagcagcugcuguucuuccgcuccaccaugcccgggugcagcggcuacccgaacauggaccucgacugccugcugccccaggagugggugcaguucuucuaccaggaggccgcccccgcgcaguccgacguggcccuccugcgguucgucaaccccgacaccggccgcgugcuguucgagugcaagcuccacaagagcggguacgugaccgucgcccacacgggcccgcacgaccuggugaucccgcccaacggguacuuccgcuucgacuccugggugaaccaguucuacacccuggcccccaugggcaacgggaccggccggcgccgggccgucuga

SEQ ID NO: 9190 - RNA, 1644 nt, Artificial Sequence
  derived and/or modified sequence opt1 from capsid_protein_VP1__Norovirus__CRL46967
augaagauggccagcaacgacgccgcgcccuccaacgacggcgccgccaaccuggugccggaggccaccagcgaggucauggcccucgagcccguggugggggcguccaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucagccaccugucccgcauguacaacggcuacgcgggcgggaugcagguccagguggugcuggccggcaacgccuucacggccgggaagaucaucuucgccgcggugccgccccacuuccccguggagaacaucagcgccgcccagaucaccaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacuccggcgaggacguguucaccgucagcugccgggugcugacccgccccgcgcccgacuucgaguucaccuuccuggugccgcccaccgucgaguccaagacgaagcccuucacccuccccauccugacccugggggagcucagcaacucccgguucccggcccccaucgacaugcuguacaccgaccccaacgaggccaucguggugcagccccagaacggccgcugcacgcuggacggcacccuccaggggaccacccagcuggucccgacgcagaucugcagcuuccggggcacccugaucucccagaccagccgcuccgccgacagcaccgacuccgcgccccgggugcgcaaccacccccuccacguccagcugaagaaccuggacgggacgccguacgaccccaccgacgaggugcccgccgugcucggcgccaucgacuucaagggcaccgucuucgggguggccagccagcggaacaccacgggcagcuccaucggggccacccgcgcccacgaggugcacaucgacaccaccaacccccgguacgcgccgaagcugggcagcguccugauguacuccgagagcacggacuucgacgacgggcagcccacccgcuucacccccaucggcaugggcgccgacgacuggcaccagugggagcuccccgaguacuccgggcaccugacccugaacaugaaccucgccccggccguggcgcccgccuuccccggcgagcggauccuguucuuccgcagcgugguccccuccgccgggggcuacgggagcggccacaucgacugccugaucccgcaggagugggugcagcacuucuaccaggaggccgcccccucccagagcgcgguggcccucauccgcuacgucaaccccgacacgggccggaacaucuucgaggccaagcugcaccgcgagggguucaucaccguggccaacuccggcaacaaccccaucguggucccgcccaacggguacuuccgguucgaggccugggugaaccaguucuacacccugacccccaugggcacggggcagggccgccggcgcgugcaguga

SEQ ID NO: 9191 - RNA, 1647 nt, Artificial Sequence
  derived and/or modified sequence opt1 from capsid_protein_VP1__Norovirus__CRL46970
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucagccuccccauccugaccaucuccgagaugagcaacucccgguuccccgugccgaucgacagccugcacacgucccccaccgagaacaucgucgugcagugccagaacgggcgcgugacccucgacggcgagcugauggggaccacgcagcugcuccccagccagaucugcgccuuccggggcguccugacccgcuccaccagccgggcgagcgaccaggccgacaccgccacgccccgccuguucaacuacuacuggcacauccagcucgacaaccugaacggcaccccguacgaccccgccgaggacauccccgggccgcugggcacccccgacuuccgggggaagguguucggcguggccucccagcgcaaccucgacaccacgacccgggcgcacgaggccaagaucgacaccaccagcgggcgcuucacgcccaagcugggcucccuggagaucagcaccgaguccagcgacuucgaccagucccagcccacccgguucaccccggucggcaucgggguggaccacgaggccgacuuccagcaguggacgcuccccgacuacgccggccaguucacccacaacaugaaccuggcgcccgccgucgcccccaacuucccgggggagcagcugcuguucuuccgcagccaccuccccuccagcggcgggcgguccaacggcauccuggacugccucgugccccaggagugggugcagcacuucuaccaggagagcgcccccucccagagccaggucgcccuggugcgcuacgugaacccggacaccggccgcguccuguucgaggcgaagcuccacaagcugggguucaugaccaucgccaagaacggcgacucccccaucaucgugccgcccaacggguacuuccgguucgagagcugggugaaccccuucuacacgcuggcccccaugggcaccgggaacggccgccggcgcauccaguga

SEQ ID NO: 9192 - RNA, 1608 nt, Artificial Sequence
  derived and/or modified sequence opt1 from capsid_protein_VP1__Norovirus__CRL46973
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgcaugaacuucguccaggccccgaacggcgaguucacggugagcccccggaacucccccggggaggugcugcucgagcuggagcugggccccgagcucaacccguuccuggcccaccugucccgcauguacaacggcuacgccgggggcgucgagguccaggugcuccuggccgggaacgccuucaccgccggcaagcugguguucgcggccaucccgccccacuucccccucgagaaccugagccccgggcagaucaccauguucccccacgugaucaucgacgugcggacccuggagcccguccuccugccccugccggacgugcgcaacaacuucuuccacuacaaccagcagcccgaggcccggaugaagcucguggccaugcuguacacgccccugcgcuccaacggcagcggcgacgacgucuucaccguguccugccgggugcucacccgccccagcccggacuucgacuucaacuaccuggucccgcccaccguggaguccaagacgaagcccuucacccugcccauccucaccaucggggagcugagcaacucccgguuccccgugcccaucgacauccuguacaccagccccaacgagggcgucguggugcagccgcagaacgggcgcuccacgcucgacggcgagcugcugggcaccacccagaucguccccagcaacaucugcgcccuccgggggcgcaucaacgcgcacgugcccaacgagccgaaccaguggaaccugcaggucaccaacgccaacggcacgcccuucgaccccaccgaggacgugcccgccccgcuggggacccccgacuuccaggccaacaucuacggcgugaccgggcagcggaacuccgacagcuccugccgcgcccacgacggcguccucgcgacguggagccccaaguucacccccaagcugggcagcguggugcuggggaccugggagaaggaggacuucaacaucaaccagccgacccgguucacgcccaucggccuccacaacaccgagcacuucaagcaguggguccugcccaacuacuccgggaugcugacccucaacaugaaccuggcccccagcguggccccgcuguuccccggcgagcagauccucuucuuccgcuccuucaucccccugaacgggggcaagagcgacggcgccaucgacugccugcucccccaggaguggauccagcacuucuaccaggaguccgccccgagccccaccgacguggcgcugauccgguacacgaaccccgacaccgggcgcguccuguucgaggccaagcuccaccggcagggcuucaucaccguggccuccagcggguccaagcccaucguggucccgcccaacggcuacuuccgcuucgacagcugggugaaccaguucuacucccuggcccccauggggaccggcaacggccggcgccgcgugcaguga

SEQ ID NO: 9193 - RNA, 1623 nt, Artificial Sequence
  derived and/or modified sequence opt1 from capsid_protein_VP1__Norovirus__CRL46976
augaagauggccagcaacgacgccgcgcccuccgacggcagcaccgccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggcgaacaacgccggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugauccacaucccgggcucccgcaacuacaccaugaaccuggccagccagaacuggaacuccuacgaccccaccgaggagauccccgcgccccuggggaccccggacuucgucggcaagauccagggggugcucacgcagaccacccggaccaacggcagcacgcgcgggcacaaggccaccguguacaccggcagcgccgacuucucccccaagcugggccggguccaguucgccaccgacacggacaacgacuucgagaccaaccagaacaccaaguucacccccgugggggugauccaggacggcagcacgacgccccgcaacgagccgcagcaguggguccugcccuccuacagcgggcggaacauccacaacgugcaccucgcccccgccguggcgcccaccuucccgggcgagcagcugcuguucuuccgcuccaccaugcccgggugcagcggcuaccccaacauggaccucgacugccugcugccccaggaguggguccaguacuucuaccaggaggccgccccggcccaguccgacguggcgcuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggaccggccgccgccgggcccucuga

SEQ ID NO: 9194 - RNA, 1623 nt, Artificial Sequence
  derived and/or modified sequence opt1 from capsid_protein_VP1__Norovirus__CRL46979
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugauccacaucccgggcagccgcaacuacaccaugaaccuggccucccagaacuggaacagcuacgaccccaccgaggagauccccgcgccccuggggaccccggacuucgucggcaagauccagggggugcucacgcagaccacccggaccaacggcagcacgcgcgggcacaaggccaccguguacaccggcuccgccgacuucagccccaagcugggccggguccaguucgccaccgacacggacaacgacuucgagaccaaccagaacaccaaguucacccccgugggggugauccaggacggcuccacgacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggaccggccgccgccgggcccucuga

SEQ ID NO: 9195 - RNA, 1623 nt, Artificial Sequence
  derived and/or modified sequence opt1 from capsid_VP1__Norovirus__ABC96332
augaagauggcccccaacgacgccagccccuccgacggcagcaccgcgaaccuggugcccgaggucaacaacgaggugauggcccucgagcccguggucggggccgccaucgccgcgcccguggccggccagcagaacgugaucgacccguggauccgcaacaacuucguccaggcccccgggggcgaguucaccgugagcccccggaacgcccccggggagauccugugguccgcgccgcugggccccgaccucaaccccuaccugucccaccuggcccgcauguacaacggcuacgccgggggcuucgaggugcaggucauccucgccgggaacgccuucacggcgggcaagaucaucuucgccgccgugcccccgaacuuccccaccgaggggcugagccccucccaggugaccauguucccccacaucaucgucgacgugcggcagcuggagccggugcucaucccccugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucaccguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucuccaucugcaccuuccggggcgacgugacccacaucccgggcacccgcaucuaccggaugaaccuggccagccagaacuggaacaacuacgaccccacggaggagauccccgcgccccuggggaccccggacuucgugggcaagauccaggggaugcucacccagaccacgaagggcgacggguccacccgcggccacaaggccaccgucagcaccggcagcguggacuucacgcccaagcugggguccgugcaguucgccaccgacaccgacaacgacuucgagaccggccagaacacgcgguucacccccgucggggugauccaggacggcagcuccgcccaccgcaacgagccccagcagugggugcugccggacuacagcgggcggaccguccacaacgugcaccucgcccccgccguggcccccaccuuccccggcgagcagcugcuguucuuccgcuccacgaugccgggcugcagcggguaccccaacauggaccucgacugccugcugccccaggaguggguccagcacuucuaccaggaggcggcccccucccagagcgacguggcccuccugcgguucgugaacccggacaccggccgcguccuguucgagugcaagcuccacaaggccggguacgugaccguggcgcacaccggccagcacgaccuggucaucccgcccaacggguacuuccgguucgacuccugggugaaccaguucuacacccuggcccccaugggcaacggcgccgggcgccgccgggcccucuga

SEQ ID NO: 9196 - RNA, 1623 nt, Artificial Sequence
  derived and/or modified sequence opt1 from major_capsid_protein_VP1__Norovirus__ADB27027
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcucccgcaacuacaccaugaaccuggccacgcagaacuggaacagcuacgacccgaccgaggagauccccgcgccccuggggacccccgacuucgugggcaagauccaggggguccucacccagacgacccgggccgacggcuccacccgcgggcacaaggccaccguguacacgggcagcgccgacuucagcccgaagcugggccggauccaguucgccaccgacaccgacaacgacuucgacgccaaccagaacaccaaguucacgcccgugggggucauccaggacggcaacaccgcgcaccgcaacgagccccagcagugggugcugcccuccuacagcgggcggaacucccacaacgugcaccucgccccggccgucgcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacguggcccuccugcgguucgucaaccccgacacgggccgcgugcuguucgagugcaagcuccacaagaccggguacgugaccgucgcccacaccggccagcacgaccuggugaucccgcccaacggguacuuccgguucgacuccugggugaaccaguucuacacccuggcgcccaugggcaacgggacgggccgccgccgggcccucuga

SEQ ID NO: 9197 - RNA, 1626 nt, Artificial Sequence
  derived and/or modified sequence opt1 from major_capsid_protein_VP1__Norovirus__AEE10003
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugauccagccccgccucugcacccacgcccgguggcccgccccggucuacggccugcugguggaccccagccuccccuccaacccccaguggcagaacgggcgcgugcgggucgacggcacccugcugggcaccaccccggugagcggguccugggucagcugcuucgcggccgaggccgccuacgaguuccaguccggcaccggggagguggccacguucacccucaucgagcaggacggcagcgcguacgugcccggggaccgcgccgcgccccugggcuacccggacuucuccggccagcuggagaucgagguccagaccgagaccacgaagaccggggacaagcucaaggugaccaccuucgagauggugcugggccccgagacgaacgucgaccaggcccccuaccaggggcggguguacgccagcgugaacgccgccgccagccuggaccucgucgacggccgcgugcgggccgugccccgcuccgucuacagcuuccaggacgugaucccggaguacaacgacgggcugcuggugccccucgcgccgcccaucggccccuuccugcccggcgagguccugcuccgguuccgcaccuacaugcggcagaucgacaccaccgacgccgccgccgaggccaucgacugcgcgcugccccaggaguucaucuccugguucgccagcaacgccuucacggugcaguccgaggcccugcuccugcgcuaccgcaacacccugaccgggcagcuccuguucgagugcaagcuguacagcgagggcuacaucgcccuguccuacagcggguccggcgcgcucaccuuccccacggacggguucuucgagguggucagcugggugccgcggcuguaccagcuggccuccgugggcagccucgccaccggccgcacccugaagcaguga

SEQ ID NO: 9198 - RNA, 1626 nt, Artificial Sequence; identical to SEQ ID NO: 9197
  derived and/or modified sequence opt1 from major_capsid_protein_VP1__Norovirus__AEE10006

SEQ ID NO: 9199 - RNA, 1626 nt, Artificial Sequence; identical to SEQ ID NO: 9197
  derived and/or modified sequence opt1 from major_capsid_protein_VP1__Norovirus__AEE10009

SEQ ID NO: 9200 - RNA, 1626 nt, Artificial Sequence
  derived and/or modified sequence opt1 from major_capsid_protein_VP1__Norovirus__AEE10015
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugauccagccccgccucugcacccacgcccgguggcccgccccggucuacggccugcugguggaccccagccuccccuccaacccccaguggcagaacgggcgcgugcgggucgacggcacccugcugggcaccaccccggugagcggguccugggucagcugcuucgcggccgaggccgccuacgaguuccaguccggcaccggggagguggccacguucacccucaucgagcaggacggcagcgcguacgugcccggggaccgcgccgcgccccugggcuacccggacuucuccggccagcuggagaucgagguccagaccgagaccacgaagaccggggacaagcucaaggugaccaccuucgagauggugcugggccccgagacgaacgucgaccaggcccccuaccaggggcggguguacgccagcgugaacgccgccgccagccuggaccucgucgacggccgcgugcgggccgugccccgcuccgucuacagcuuccaggacgugaucccggaguacaacgacgggcugcuggugccccucgcgccgcccaucggccccuuccugcccggcgagguccugcuccgguuccgcaccuacaugcggcagaucgacaccaccgacgccgccgccgaggccaucgacugcgcgcugccccaggaguucguguccugguucgccagcaacgccuucacggugcaguccgaggcccugcuccugcgcuaccgcaacacccugaccgggcagcuccuguucgagugcaagcuguacagcgagggcuacaucgcccuguccuacagcggguccggcgcgcucaccuuccccacggacggguucuucgaggucgugagcugggugccgcggcuguaccagcuggccuccgucggcagccucgccaccggccgcacccugaagcaguga

SEQ ID NO: 9201 - RNA, 1626 nt, Artificial Sequence; identical to SEQ ID NO: 9197
  derived and/or modified sequence opt1 from major_capsid_protein_VP1__Norovirus__AEE10018

SEQ ID NO: 9202 - RNA, 1626 nt, Artificial Sequence; identical to SEQ ID NO: 9200
  derived and/or modified sequence opt1 from major_capsid_protein_VP1__Norovirus__AEE10021

SEQ ID NO: 9203 - RNA, 1626 nt, Artificial Sequence
  derived and/or modified sequence opt1 from major_capsid_protein_VP1__Norovirus__AEE10024
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugauccagccccgccucugcacccacgcccgguggcccgccccggucuacggccugcugguggaccccagccuccccuccaacccccaguggcagaacgggcgcgugcacgucgacggcacccugcugggcaccaccccgaucagcggguccugggugagcugcuucgcggccgaggccgccuacgaguuccaguccggcaucggggaggucgccaccuucaaccucaucgagcaggacggcagcgcguacacgcccggggaccgggccgcgccccugggcuacccggacuucuccggccagcuggagaucgaggugcagaccgagaccaccaagacgggggacaagcucaaggugaccaccuucgagauggcccugggccccaagaccaacgucgaccagacgcccuaccaggggcgcguguucgccagcaucaccguggccgccagccuggaccucgucgacggccgggugcgcgccgugccccgguccgucuacggguuccaggacaccaucccggaguacaacgacggccugcuggugccccucgccccgcccaucggccccuuccugcccggggaggugcugcuccgcuuccggaccuacaugcgccagcuggacgcgacggacgccgccgccgaggccaucgacugcgcgcugccccaggaguucgucagcugguucgccuccaacgccuucaccgugcagagcgaggcccuccugcugcgguaccgcaacacccucaccggccagcugcuguucgagugcaagcuguacuccgagggguacaucgcccucagcuacuccggcagcgggccccugacguucccgaccgacggcuucuucgagguggucuccugggugccccgccuguaccagcucgcgagcgugggcucccuggccaccgggcggacccugaagcaguga

SEQ ID NO: 9204 - RNA, 1626 nt, Artificial Sequence
  derived and/or modified sequence opt1 from major_capsid_protein_VP1__Norovirus__AEE10027
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugcuccagccccgccugugcacccacgcccgguggcccgccccggucuacggccugcucguggaccccagccugcccuccaacccccaguggcagaacgggcgcgugcacgucgacggcacccugcucggcaccaccccggugagcggguccugggucagcugcuucgcggccgaggccgccuacgaguuccaguccggcaccggggagguggccacguucaccaugaucgagcaggacggcagcgcguacgugcccggggaccgggccgcgccccugggcuacccggacuacuccggccagcuggagaucgagguccagaccgagaccacgaagaccggggacaagcuccgcgugaccaccuucgagaugauccugggccccacgaccaacguggaccaggcccccuaccaggggaaggucuacgccagccugagcaccuccgccagccucaaccugguggacggccgggugcgcgccgucccccgguccguguacagcuuccaggacgugcugccggaguacaacgacgggcuccuggucccccuggccccgccccucggccccuuccugcccggcgaggugcugcuccgcuuccggaccuacaugcgccagcuggacacggccgacgcgaccgcccagcccaucgacugcgcccugccccaggaguucaucuccugguucgccagcaacaacuucaccgugcaguccgacgcccuccugauccgguaccgcaacacccugacggggcagcuccuguucgaggcgaagcuguacagcgagggcuacaucgccgucuccuacagcggguccggcccgcugaccuuccccaccgacggguucuucgagguggugagcugggucccccgccucuuccagcuggccuccgugggcagccuggccaccggccggacgcucaagcaguga

SEQ ID NO: 9205 - RNA, 1608 nt, Artificial Sequence
  derived and/or modified sequence opt1 from major_capsid_protein_VP1__Norovirus__AGI96385
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgcaugaacuucguccaggccccgaacggcgaguucacggugagcccccggaacucccccggggaggugcugcucaaccuggagcugggccccgagcucaacccguuccuggcgcaccugucccgcauguacaacggcuacgccgggggcgccgagguccaggugcuccuggccgggaacgccuucaccgcgggcaagcugguguucgccgccaucccgccccacuucccccucgagaaccugagccccgggcagaucaccauguucccccacgucaucaucgacgugcggacccuggagcccgugcuccugccccugccggacguccgcaacaacuucuuccacuacaaccagcagcccgagccccggaugcgccucguggccaugcuguacacgccccugcgguccaacggcagcggcgacgacguguucaccgucuccugccgcgugcucacccggccgagccccgacuucgacuucaacuaccuggugccgcccaccgucgaguccaagacgaagcccuucacccugcccauccucaccaucggggagcugagcaacucccgcuuccccgugcccaucgacgagcuguacaccagcccgaacgagggcgugaucguccagccccagaacgggcgguccacgcucgacggcgagcugcugggcaccacccagcucgugcccagcaacaucugcgcccugcgcgggcggaucaacgcccaggugccggacgaccaccaccaguggaaccugcaggucaccaacgccaacggcacguccuucgaccccaccgaggacgugcccacgccccucgggaccccggacuuccuggccaacaucuacggcgucaccagccagcgcaaccccgacaacacgugccgggcccacgacggggugcuggccaccuggucccccaaguucacccccaagcucggcagcgugguccugggcaccugggaggagagcgaccuggaccucaaccagccgacccgcuucacccccguggggcuguacgacaccaaccacuucgaccaguggauccugcccaacuacuccggccggcucacgcugaacaugaaccuggcgcccagcguggccccgcuguuccccggggagcagauccucuucuuccgcucccacaucccccugaagggcgggaccagcaacggcgccaucgacugccuccugccccaggaguggauccagcacuucuaccaggaguccgccccgagccccaccgacgucgcccugauccgguacaccaaccccgacacgggccgcgugcuguucgaggcgaagcuccaccggcagggguucaucaccguggccaacuccggcagccgccccaucgucgugccgcccaacggguacuuccgcuucgacuccugggugaaccaguucuacagccuggcccccaugggcaccgggaacggccggcgccggguccaguga

SEQ ID NO: 9206 - RNA, 1644 nt, Artificial Sequence
  derived and/or modified sequence opt1 from major_capsid_protein_VP1__Norovirus__AGI96397
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucaacgccgcccagaucacgaugugcccccacgucaucguggacgugcggcagcucgagcccguccugcugccccuccccgacauccgcaaccgguucuuccacuacaaccaggagaacaccucccgcaugcggcugguggccaugcuguacaccccgcuccgcgccaacagcggcgaggacguguucaccgucuccugccgggugcugacgcgccccgcgcccgacuucgaguucaccuuccuggugcccccgaccgucgagagcaagaccaagcccuucucccuccccauccugacgcugggggagcucagcaacucccgguuccccgccccgaucgacaugcuguacaccgaccccaacgagggcaucguggugcagccccagaacggccgcugcacccuggacgggacccuccagggcacgacccagcugguccccacccagaucugcgccuuccgggggacccugaucggccagacgagccgcuccccggacagcaccgacuccgcgccccggcgccgggaccacccccuccacgugcagcugaagaaccuggacggcacccaguacgacccgaccgacgagguccccgccgugcucggggccaucgacuucaagggcacgguguucggggucgccagccagcgcgacguguccggccagcaggucggggccacccgggcccacgaggugcacaucaacaccaccgacccccgcuacacgcccaagcugggcagcauccugauguacagcgaguccgacgacuucgugaccggccagccggugcgguucacccccaucgggaugggcgacaacgacuggcaccagugggagcuccccgacuaccccgggcaccugacccugaacaugaaccucgccccggcggucgcccccgccuuccccggcgagcgcauccuguucuuccgcagcaucgugcccuccgccgggggcuacggcagcgggcagaucgacugccugaucccgcaggagugggugcagcacuucuaccaggaggcggcccccucccagagcgccgucgcccucauccgguacgugaaccccgacacgggccgcaacaucuucgaggccaagcugcaccgggagggguucaucaccguggcgaacuccggcaacaaccccaucgucgugccgcccaacggguacuuccgcuucgaggccugggugaaccaguucuacacccugacccccaugggcacgggccaggggcggcgccgggaccaguga

SEQ ID NO: 9207 - RNA, 1608 nt, Artificial Sequence
  derived and/or modified sequence opt1 from major_capsid_protein_VP1__Norovirus__AGI96398
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgcaugaacuucguccaggccccgaacggcgaguucacggugagcccccggaacucccccggggaggugcugcucaaccuggagcugggccccgagcucaacccguuccuggcccaccugucccgcauguacaacggcuacgccgggggcgucgagguccaggugcuccuggccgggaacgccuucaccgccggcaagcugguguucgcggccaucccgccccacuucccccucgagaaccugagccccgggcagaucaccauguucccccacgugaucaucgacgugcggacccuggagcccguccuccugccccugccggacgugcgcaacaacuucuuccacuacaaccagcagcccgagccccggaugcgccucguggccaugcuguacacgccccugcgguccaacggcagcggcgacgacgucuucaccguguccugccgcgugcucacccggccgagccccgacuucgacuucaacuaccuggucccgcccaccguggaguccaagacgaagcccuucacccugcccauccucaccaucggggagcugagcaacucccgcuuccccgugcccaucgacgagcuguacaccagcccgaacgagggcgucaucgugcagccccagaacgggcgguccacgcucgacggcgagcugcugggcaccacccagcucgugcccagcaacaucugcgcccugcgcgggcggaucaacgcccaggucccggacgaccaccaccaguggaaccuccaggugaccaacgcgaacggcacguccuucgaccccaccgaggacguccccgcgccccucgggaccccggacuuccuggccaacaucuacggcgugaccagccagcgcaaccccgacaacacgugccgggcccacgacggggugcuggccaccuggucccccaaguucacccccaagcucggcagcgucgugcugggcaccugggaggagagcgaccuggaccucaaccagccgacgcgcuucacccccguggggcuguacgacaccaaccacuucgaccaguggauccugcccaacuacuccggccggcucacccugaacaugaaccuggcccccagcgucgccccgcuguuccccggggagcagauccuguucuuccgcucccacaucccccugaagggcgggacgagcaacggcgccaucgacugccuccugccccaggaguggauccagcacuucuaccaggaguccgccccgagccccaccgacguggcccugauccgguacaccaaccccgacaccggccgcgugcuguucgaggcgaagcuccaccggcagggguucaucacggucgccaacuccggcagccgccccaucguggugccgcccaacggguacuuccgcuucgacuccugggucaaccaguucuacagccuggcccccaugggcaccgggaacggccggcgccgggugcaguga

SEQ ID NO: 9208 - RNA, 1608 nt, Artificial Sequence
  derived and/or modified sequence opt1 from major_capsid_protein_VP1__Norovirus__AGI96399
augaagauggccagcaacgacgccgcgcccuccaacgacgacgccgccggccuggugccggaggucaacaacgagaccauggcccucgagcccguggccggggcgagcaucgccgcgccccugaccggccagaacaacgugaucgaccccuggauccgcaugaacuucguccaggccccgaacggggaguucacggugagcccccggaacucccccggcgaggugcugcucaaccuggagcuggggcccgagcucaacccguuccuggcccaccugucccgcauguacaacggcuacgccggcggggucgagguccaggugcuccuggccggcaacgccuucaccgccgggaagcugguguucgcggccaucccgccccacuucccccucgagaaccugagccccggccagaucaccauguucccccacgugaucaucgacgugcggacccuggagcccguccuccugccccugccggacgugcgcaacaacuucuuccacuacaaccagcagcccgagccccggaugcgccucguggccaugcuguacacgccccugcgguccaacgggagcggcgacgacgucuucaccguguccugccgcgugcucacccggccgagccccgacuucgacuucaacuaccuggucccgcccaccguggaguccaagacgaagcccuucgcccugcccauccucaccaucggcgagcugagcaacucccgcuuccccgugcccaucgacgagcuguacaccagcccgaacgagggggucaucgugcagccccagaacggccgguccacccucgacggggagcugcugggcacgacccagcucgugcccagcaacaucugcgcccugcgcggccggaucaacgcgcaggucccggacgaccaccaccaguggaaccuccaggugaccaacgccaacgggaccuccuucgaccccacggaggacguccccgcgccccucggcaccccggacuuccuggccaacaucuacggggugaccagccagcgcaaccccgacaacacgugccgggcccacgacggcgugcuggccaccuggucccccaaguucacccccaagcucgggagcgucgugcugggcaccugggaggagagcgaccuggaccucaaccagccgacccgcuucacgcccgugggccuguacgacaccaaccacuucgaccaguggauccugcccaacuacuccgggcggcucacccugaacaugaaccuggcccccagcgucgccccgcuguuccccggcgagcagauccuguucuuccgcucccacaucccccugaagggcgggaccagcaacggggccaucgacugccuccugccccaggaguggauccagcacuucuaccaggaguccgccccgagccugacggacguggcgcugauccgguacaccaaccccgacaccggccgcguccucuucgaggccaagcugcaccggcagggcuucaucaccguggccaacuccgggagccgccccaucguggugcccccgaacggcuacuuccgcuucgacuccugggucaaccaguucuacagccuggcccccauggggacgggcaacgggcggcgccgggugcaguga

SEQ ID NO: 9209 - RNA, 1617 nt, Artificial Sequence
  derived and/or modified sequence opt1 from major_capsid_protein_VP1__Norovirus__AGJ52175
augauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgauccagggcauguucaugucccccgacgucaaccagagcgugcaguuccagaacgggcgcugccagaucgacggccagcugcaggggaccacccccgugucccucagccagcugugcaagauccggggcaagacguccagcaacgcccgcguccugaaccucagcgagguggacgggacccccuucaucccgcuggagucccccgcccccgucggcuucccggaccugggcgggugcgacuggcacgugaacuucagcuuccagacccaggaccgggaccccucccagagcgugaccuucgcgacgaacgacgccuccuucguccccuaccucggcagcgugagcccccacaacggggagggcuuccaggccggggacaucaucggcucccugggcuggaucuccgccccgagcgacaacucccaguucaacgugugggccauccccaaguacgggagcucccugcagaugagccccauccuccugcugcucugcagcccccgccugugggaggucauccuguacuucuacuccaccuucccgggcuccgggcagcccagccagcuccaggugcccugccugcugccccaggaguucaucacccacuucugcaacgagcaggcgccgaucgccggcgaggccgcccuccugcacuacguggaccccgacaccgggcggaaccugggcgaguucaagcucuaccccgacggcuucaugacgugcguccccaacuccgugagcagcgggccgcagacccugcccaucaacggcguguucgucuucguguccugggugagccgcuucuaccagcugaagcccgucgggaccgcguccgccgcccggcgccucggccugcggcgcaucuga

SEQ ID NO: 9210 - RNA, 1641 nt, Artificial Sequence
  derived and/or modified sequence opt1 from major_capsid_protein_VP1__Norovirus__AGX01092
augaugauggccagcaaggacgcgccccaguccgccgacggcgccagcggggccggccagcuggugccggaggucaacaccgccgacccccuccccauggagcccguggccgggccgaccacggcgguggccaccgccggccaggucaacaugaucgaccccuggaucgugaacaacuucgugcagagcccccagggggaguucaccaucucccccaacaacaccccgggcgacauccuguucgaccugcagcucggcccccaccugaaccccuuccugucccaccucagccagauguacaacgggugggucggcaacaugcgcgugcggauccugcuggccgggaacgcguucuccgccggcaagaucaucgugugcuucgugcccccgggguucacgagcuccagccucaccaucgcccaggccacccuguucccccacgucaucgccgacgugcgcacccuggagcccaucgagaugccccucgaggacguccggaacgugcuguaccacacgaacgacaaccagccgaccaugcgccuggugugcaugcucuacacgccccugcggaccggcggcggguccggcagcuccgacagcuucgucguggcggggcgcgugcugaccgcccccuccagcgacuucuccuuccucuuccuggugcccccgaccaucgagcagaagacccgggccuucaccguccccaacaucccccugcagacgcucagcaacucccgcuuccccagccugauccagggcaugauccugagcccggacgccucccaggugguccaguuccagaacggccggugccucaucgacgggcagcugcugggcaccacccccgccaccagcgggcagcuguuccgcgugcggggcaagaucaaccagggggcgcgcacgcucaaccugaccgagguggacggcaagcccuucauggccuucgacucccccgccccggucggcuuccccgacuucgggaagugcgacuggcacaugcggaucagcaagacccccaacaacaccuccagcggcgacccgaugcgcuccgugagcguccagacgaacgugcagggguucgugccccaccucggcuccauccaguucgacgaggucuucaaccaccccaccggggacuacaucggcaccaucgaguggaucagccagcccuccaccccgcccggcacggacaucaaccugugggagauccccgacuacgggagcucccugagccaggccgccaaccucgcgcccccgguguucccgcccggcuucggggaggcccugguguacuucgucuccgccuuccccggccccaacaaccggagcgcccccaacgacgugcccugccugcucccccaggaguacaucacccacuucguguccgagcaggccccgaccaugggggacgcggcccugcugcacuacgucgaccccgacaccaaccgcaaccucggcgaguucaagcuguaccccggcggguaccugacgugcgugcccaacggcgugggggccggcccgcagcagcucccccugaacggcgucuuccuguucgugagcugggugucccgguucuaccagcucaagcccgucgggaccgccagcaccgcgcgcggccggcugggggugcgccggaucuga

SEQ ID NO: 9211 - RNA, 1647 nt, Artificial Sequence
  derived and/or modified sequence opt1 from major_capsid_protein_VP1__Norovirus__AGX01095
augaagauggccagcaacgacgccgcgcccuccaacgacggcgccgccgggcuggugccggagaucagcuccgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucagccuccccauccugaccaucuccgagaugagcaacucccgguuccccgugccgaucgacagccugcacacgucccccaccgagaacaucgucgugcagugccagaacgggcgcgugacccucgacggcgagcugauggggaccacgcagcugcuccccagccagaucugcgccuuccggggcacccugacccgcagcaccucccgggcgagcgaccaggccgacacggccacgccccgccuguucaacuacuacuggcacauccagcucgacaaccugaacggcaccccguacgaccccgccgaggacauccccgccccgcuggggacccccgacuuccggggcaaggucuucgggguggcgucccagcgcaaccccgacgccaccacccgggcccacgaggccaagaucgacaccaccagcggccgcuucacgcccaagcucgggucccuggagaucagcaccgaguccggcgacuucgaccagaaccagccgacccgguucacccccgugggcaucggggucgaccacgagcccgacuuccagcagugggcgcugcccgacuacgccggccaguucacgcacaacaugaaccucgccccggccguggcccccaacuuccccggggagcagcugcuguucuuccgcagccagcuccccuccagcggcgggcgguccaacggcauccuggacugccuggucccgcaggagugggugcagcacuucuaccaggagagcgcgcccucccagacccagguggcccucguccgcuacgugaaccccgacaccggccgcgugcuguucgaggccaagcugcacaagcuccgguucaugaccaucgccaagagcggggacucccccaucacggucccgcccaacggcuacuuccgcuucgagagcugggugaaccccuucuacacccuggcccccauggggaccggcaacgggcggcgccggauccaguga

SEQ ID NO: 9212 - RNA, 1623 nt, Artificial Sequence
  derived and/or modified sequence opt1 from major_capsid_protein_VP1__Norovirus__AGX01098
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccugggggcccccgacuucgugggcaagauccaggggguccucacgcagaccacccggaccgacggcagcacgcgcgggcacaaggccaccguguacaccggcagcgccgacuucgccccgaagcugggccgggugcaguucgagaccgacacggaccacgacuucgaggucaaccagaacaccaaguucacccccgugggggugauccaggacggcgggaccacgcaccgcaacgagccccagcaguggguccugcccuccuacagcggccggaacaccccgaacgugcaccucgcccccgcgguggcccccaccuuccccggggagcagcugcuguucuuccgcuccaccaugccgggcugcagcggcuaccccaacauggaccucgacugccugcugccccaggaguggguccaguacuucuaccaggaggccgcccccgcgcaguccgacguggcccuccugcgguucgugaacccggacacggggcgcguccuguucgagugcaagcuccacaagagcggcuacgugaccguggcccacaacgggcagcacgaccuggucaucccgcccaacggcuacuuccgguucgacuccugggugaaccaguucuacacccuggcccccauggggaacggcaccggccgccgccgggcccucuga

SEQ ID NO: 9213 - RNA, 1623 nt, Artificial Sequence
  derived and/or modified sequence opt1 from major_capsid_protein_VP1__Norovirus__AKI30060
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccaucaaccuccgcaucagcgacaacgacgacuuccaguuccagcccaccaaguucacccccgucggggugaacgacgacgacgacggccaccccuuccggcagugggagcugccgaacuacuccggggagcugacccucaacaugaaccuggccccgcccguggcccccaacuuccccggcgagcagcuccuguucuuccgcagcuucguccccugcuccgggggcuacaaccagggcaucaucgacugccugaucccccaggaguggauccagcacuucuaccaggagagcgcccccucccagagcgacguggcccugauccgguacgugaacccggacacggggcgcacccucuucgaggcgaagcugcaccgcuccggcuacaucaccgucgcccacagcggggacuacccccugguggugcccgccaacggccacuuccgguucgacuccugggucaaccaguucuacagccucgcccccauggggaccggcaacggccgccggcgcgcgcaguga

SEQ ID NO: 9214 - RNA, 1626 nt, Artificial Sequence
  derived and/or modified sequence opt1 from major_capsid_protein_VP1__Norovirus__BAQ94514
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucagccaccugucccgcauguacaacggcuacgccggcgggguggaggugcagguccugcucgccggcaacgccuucaccgccgggaagauccuguucgcggccaucccgcccaacuuccccguggacaugaucagccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcgguccaacggcagcggggacgacguguucaccguguccugccgcguccucacccggcccacgcccgacuucgaguucuucuaccuggugcccccgagcguggaguccaagaccaagagcuucacccugcccauccucaccaucuccgagaugacgaacagccgcuuccccauccccaucgagcagcuguacaccgccccgaacgagaccaacgucgugcagugccagaacggccggugcacccuggacggcgagcuccaggggacgacccagcugcuguccagcgcgaucugcuccuaccgcggccggacccucgccaacaacgacagcugggaccagaaccugcugcagcucagcuaccccaacggggccuccuacgaccccaccgacgaggugccggcgccccugggcacgcaggacuucagcggcauccuguacgggguccucacccaggacaacgugaccgagggcaccggggaggccaagaacgccaagggcaucuacaucuccacgaccagcgggaaguucacccccaagaucggcuccaucggccugcacagcaucaccggggacgugcaccacaaccagcagucccgcuucacgcccgucggcaucgccgugaacgagaacaccccguucaagcaguggguccugccccacuacagcgggucccucgcccugaacaccaaccuggcccccgccguggcgcccaccuucccgggcgagcagcuccuguucuuccggagccgcgugcccugcguccaggggcugcacggccaggacgccuucaucgacugccuccugccccaggagugggugaaccacuucuaccaggaggccgcccccucccagacggacguggcgcugauccgguucgucaacccggacaccggccgcacccucuucgaggccaagcugcaccggagcggguucaucaccgugucccacacgggcaacuacccccuggugaucccgcccaacgggcacuuccgcuucgacagcugggucaaccaguucuacucccucgcccccaugggcaccgggaacggccggcgccgcauccaguga

SEQ ID NO: 9215 - RNA, 1626 nt, Artificial Sequence
  derived and/or modified sequence opt1 from major_capsid_protein_VP1__Norovirus__BAQ94516
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucagccaccugucccgcauguacaacggcuacgccggcgggguggaggugcagguccugcucgccggcaacgccuucaccgccgggaagauccuguucgcggccaucccgcccaacuuccccguggacaugaucagccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcgguccaacggcagcggggacgacguguucaccguguccugccgcguccucacccggcccacgcccgacuucgaguucuucuaccuggugcccccgagcguggaguccaagaccaagcccuucacccugcccauccucaccaucagcgagaugacgaacucccgcuuccccaucccgaucgagcagcuguacaccgcccccaacgagaccaacgucgugcagugccagaacggccggugcacccuggacggcgagcuccaggggacgacccagcugcugagcuccgcgaucugcagcuaccgcggccggacccucgccaacaacgacuccugggaccagaaccugcugcagcucagcuaccccaacggggccagcuacgacccgaccgacgaggugcccgcgccccugggcacgcaggacuucuccggcauccuguacgggguccucacccaggacaacgugaccgagggcaccggggaggccaagaacgccaagggcaucuacaucagcacgaccuccgggaaguucacccccaagaucggcagcaucggccugcacuccaucaccggggacgugcaccacaaccagcagagccgcuucacgccggucggcaucgccgugaacgagaacacccccuucaagcaguggguccugccccacuacuccgggagccucgcccugaacaccaaccuggcccccgccguggcgccgaccuuccccggcgagcagcuccuguucuuccggucccgcgugcccugcguccaggggcugcacggccaggacgccuucaucgacugccuccugccccaggagugggugaaccacuucuaccaggaggccgccccgagccagacggacguggcgcugauccgguucgucaaccccgacaccggccgcacccucuucgaggccaagcugcaccgguccggguucaucaccgugagccacacgggcaacuacccccuggugaucccgcccaacgggcacuuccgcuucgacuccugggucaaccaguucuacagccucgcccccaugggcaccgggaacggccggcgccgcauccaguga

SEQ ID NO: 9216 - RNA, 1629 nt, Artificial Sequence
  derived and/or modified sequence opt1 from major_capsid_protein_VP1__Norovirus__BAQ94520
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgagcgcaccggggaggccaagaacgccaagggcaucuacaucagcaccacguccgggaaguucacccccaagaucggcagcaucggccugcacuccaucaccgagaacgugcacccgaaccagcagagccgguucacccccgucgggguggcccagaacgagaacacgcccuuccagcagugggugcugccccacuacgccggcgcccucgcgcugaacaccaaccuggccccggccgucgcccccaccuuccccggggagcagcuccuguucuuccgcucccgggugcccugcgugcagggccugcaggggcaggacgcguucaucgacugccuccugccgcaggagugggucaaccacuucuaccaggaggccgcccccagccaggccgacguggcccugauccgcuacgugaaccccgacaccggccggacccucuucgaggcgaagcugcaccgcuccggcuucaucacggucagccacaccggggccuacccccugguggugccgcccaacggccacuuccgguucgacuccugggucaaccaguucuacagccucgcccccauggggaccggcaacgggcgccgccgggugcaguga

SEQ ID NO: 9217 - RNA, 1629 nt, Artificial Sequence
  derived and/or modified sequence opt1 from major_capsid_protein_VP1__Norovirus__BAQ94524
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagcaccagccccggaugcgccucgucgccaugcuguacacgccccugcggagcaacggcuccggggacgacguguucaccgugagcugccgcguccucacccggccgacgcccgacuucgaguucaucuaccuggugccgcccuccguggagagcaagaccaagcccuucacccugcccauccucaccaucuccgagcugacgaacagccgcuuccccauccccaucgagcagcuguacaccgcgccgaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgaccccaccgacgaggugccggcgccccugggcacgcaggacuucagcgggauccuguacggcgugcucacccaggacaacgucuccgagcgcaccggggaggccaagaacgccaagggcaucuacaucagcaccacguccgggaaguucacccccaagaucggcagcaucggccugcacuccaucaccgagaacgugcaccccaaccagcagagccgguucaccccggucgggguggcccagaacgagaacacgcccuuccagcagugggugcugccccacuacgccggcgcccucgcgcugaacaccaaccuggcccccgccgucgccccgaccuuccccggggagcagcuccuguucuuccgcucccgggugcccugcgugcagggccugcaggggcaggacgcguucaucgacugccuccugccccaggagugggucaaccacuucuaccaggaggccgccccgagccaggccgacguggcccugauccgcuacgugaaccccgacaccggccggacccucuucgaggcgaagcugcaccgcuccggcuucaucaccgucagccacaccggggccuacccccugguggugcccccgaacggccacuuccgguucgacuccugggucaaccaguucuacagccucgcccccauggggaccggcaacgggcgccgccgggugcaguga

SEQ ID NO: 9218 - RNA, 1629 nt, Artificial Sequence
  derived and/or modified sequence opt1 from major_capsid_protein_VP1__Norovirus__BAQ94526
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccacguccgagcugaccaacagccgcuuccccaucccgaucgagcagcuguacaccgcgcccaacgagaacaacgucgugcagugccagaacggccggugcacccucgacggcgagcugcaggggacgacccagcugcucuccagcgccgugugcuccuaccgcggccggaccgucgccaacagcggggacaacugggaccagaaccugcugcagcucaccuaccccuccggcgccagcuacgacccgacggacgaggugcccgcgccccugggcacccaggacuucagcgggauccuguacggcgugcucacccaggacaacgucuccgagcgcaccggggaggccaagaacgccaagggcaucuacaucagcacgaccuccgggaaguucacccccaagaucggcagcaucggccugcacuccaucaccgagaacgugcacccgaaccagcagagccgguucacgcccgucgggguggcccagaacgagaacacccccuuccagcagugggugcugccccacuacgccggcgcccucgcgcugaacaccaaccuggccccggccgucgcccccaccuuccccggggagcagcuccuguucuuccgcucccgggugcccugcgugcagggccugcaggggcaggacgcguucaucgacugccuccugccgcaggagugggucaaccacuucuaccaggaggccgcccccagccaggccgacguggcccugauccgcuacgugaaccccgacacgggccggacccucuucgaggcgaagcugcaccgcuccggcuucaucaccgucagccacaccggggccuacccccugguggugccgcccaacggcuacuuccgguucgacuccugggucaaccaguucuacagccucgcccccauggggacgggcaacgggcgccgccgggugcaguga

SEQ ID NO: 9219 - RNA, 1587 nt, Artificial Sequence
  derived and/or modified sequence opt1 from VP1_capsid_protein__Norovirus__ACV89840
augaugauggccagcuccgacgccacgcccccgagcgagggcgcgaccaaccuggugcccgaggucaacacccagguggugccccucgagcccgucgccggggccgccgccgcggccccguucaccggccagaacaacgugaucgaccccuggaucuuccagaacuucgugcaggcgccccagggggaguucaccgucagcccccgcaacaccccgggcgagauccugcugcggaucccccucgggcccaaccugaaccccuuccuggcccaccucucccgcauguacaacgccugggugggcggcauggaggccgagaugauccuggccgggaacgccuucacggccggcaagcugcucaucguggcgcugccgcccggguucgaggccacccagcugacccccgcccaggccaccgccuucccccacgucaucgcggacgugcggacgcucgagccgauccccaucccccugcccgacauccgcaacgugcuguuccacuacaacggcgacccgacccccaccauccagaucgucgugaugcucuacacgccccugcggaccaacgggaacggcgacgacguguucaccgucuccggccgccugcucacccggcccgccccggacuucagcuucuccuuccuggugccgcccaccguggagcagaagacgcgcagcuucacccugcccaaccucgccgucuccgaccugagcaacucccgguuccccgcccccgugaacauccugcgcgccgaccccaacaccacccucgcgcuggacuaccagaacgggcggugcacgcuggacggcgcccuccaggggaccaccccgaccaacagcuccuuccugggcuaccugcgcggcacgguggaccgggucaacagcgaccaggugcacgugcaccuccgcgagcccaacggggaccccuuccagcugggccugcccgggccgcagggcguccccgacuaccgggccacccucgacaucuacguggacugggagaacaagaaccacgggaaccccugcgagggcacccugaacaccggcucccagacggaguacacccccgggcugggcacccucaccuucaacaagacgagcggggacaccccggagcagggcgaccccgucaucaugcgccugguggccuuccgguccaaccugaccgaccagcuccccgccuacaacggggcguucggccagggcgagaaccuggcgcccccggugagcccgcccguccccggggagguguuccugcaguucggcucccgcuacacccggcucggggagcgcgagcuggccgugcagugccugcuccccagcgaguggaucacgcacuucuacagcgaggccgcccccauccagggcgaggccaugcugcugcgguacguccagcccgaccucgggcgcauccuguucgaggccaagcuguacaaggagggcuucgugaccguggccggcgggaccaaccccgucaccuucccgaucgacggcaccuucguggccguguccugggucagccgcaacuucgugcugucccccauggggagcggccagggccggcgccgggcggcccucgccgaguga

SEQ ID NO: 9220 - RNA, 1587 nt, Artificial Sequence
  derived and/or modified sequence opt1 from VP1_capsid_protein__Norovirus__ACV89843
augaugauggccagcuccgacgccacgcccccgagcgagggcgcgaccaaccuggugcccgaggucaacacccagguggugccccucgagcccgucgccggggccgccgccgcggccccguucaccggccagaacaacgugaucgaccccuggaucuuccagaacuucgugcaggcgccccagggggaguucaccgucagcccccgcaacaccccgggcgagauccugcugcggaucccccucgggcccaaccugaaccccuuccuggcccaccucucccgcauguacaacgccugggugggcggcauggaggccgagaugauccuggccgggaacgccuucacggccggcaagcugcucaucguggcgcugccgcccggguucgaggccacccagcugacccccgcccaggccaccgccuucccccacgucaucgcggacgugcggacgcucgagccgauccccaucccccugcccgacauccgcaacgugcuguuccacuacaacggcgacccgacccccaccauccagaucgucgugaugcucuacacgccccugcggaccaacgggaacggcgacgacguguucaccgucuccggccgccugcucacccggcccgccccggacuucagcuucuccuuccuggugccgcccaccguggagcagaagacgcgccccuucacccugcccaaccucgccgucagcgaccuguccaacagccgguuccccgcccccgugaacauccugcgcgccgacccgaacaccacccucgcgcuggacuaccagaacgggcggugcacgcuggacggcgcccuccaggggaccacccccaccaacuccagcuuccugggcuaccugcgcggcacgguggaccgggucaacuccgaccaggugcacgugcaccuccgcgagcccaacggggaccccuuccagcugggccugccggggccccagggcguccccgacuaccgggccacccucgacaucuacguggacugggagaacaagaaccacgggaaccccugcgagggcacccugaacaccggcagccagacggaguacaccccggggcugggcacccucaccuucaacaagacguccggggacacccccgagcagggcgaccccgucaucaugcgccugguggccuuccggagcaaccugaccgaccagcuccccgccuacaacggggcguucggccagggcgagaaccuggccccgcccguguccccgcccguccccggggagguguuccugcaguucggcagccgcuacacccggcucggggagcgcgagcuggccgugcagugccugcuccccuccgaguggaucacgcacuucuacagcgaggccgcgcccauccagggcgaggccaugcugcugcgguacguccagcccgaccucgggcgcauccuguucgaggccaagcuguacaaggagggcuucgugaccguggccggcgggaccaacccggucaccuuccccaucgacggcaccuucguggccgugagcugggucucccgcaacuucgugcugagccccaugggguccggccagggccggcgccgggcggcccucgccgaguga

SEQ ID NO: 9221 - RNA, 1767 nt, Artificial Sequence
  derived and/or modified sequence opt1 from VP1_capsid_protein__Norovirus__AFV48046
augcgccugcagugggaggccuggcggagcaccuuccccggcaugcagccgcccugcguggggugcggccucgggcccucccugcugcgcccccggcgcaucguccagccguaccuccugaugcggaugagcgacgccgugcaccgcggcaacgcggccgacacccagggggccuccgccggcgagggcagcaaccuggugcccuccacggucgaccaggccauccccauccagcccguggcgggggccgccaucgccgcgccgaccgccggccaggugaaccagaucgaccccuggauccgggagaacuucguccagugcccccucggggaguucaccgugagcccccgcaacaccccgggcgaggugcuguucaaccuggcccucgggcccggccugaaccccuaccugucccaccucgccgccauguacacgggcugggucgggaacauggaggugcagcuggugcuggcgggcaacgccuucaccgccgggaaggucgugguggcccucaucccgcccuacuucaacaugcagacccugaccacgagccagaucacgugcuucccccacaucaugugcgacguccggacccuggagcccauccuccugccccugcucgacgugcgccggacccuguggcacccgaccaacuccgaggacgacaccaugcgccuggugugcaugcucuacacgccccugcggaccaacagccccggcgacgaguccuucgucgugagcggccgccugcucucccggcccagccuggacuucaacuuccuguaccucaccccgcccaucgcccagacccccuacgagcugcccaccgugccgcgcaugguccccuccgagaugacccacagccgguggcccgcgccgaucuaccaggugguggccgaccccucccuggucgccaacccccaguggcagaacgggcgcgugacgaucgacggccagcuccuggggaccacccccaucagcuccaccugggucugcagcaucgccggcacggccgacuaccgguacaucgcggggaccgacagcuucgaggagugcaagcuggcccucucccagccgaacggcagccccuucguggugggcgacgcccccgcccccuacggguacccggacuucaacgccaccaucuccuucagcuuccaggucgagacccgccagaacuccgcguacagcgugcgggaguucucccugacgaccagcucccagaccaucaaccagagccccuacaccggcacgguguacauggaccgcuccgagacccaggacuaccaguaccaggacgaccgcauccgcggggucccccacagcgugcaguccuucaaggaccagcugcccgacuacguggagagcggccagccgcccaaccucgccccgcccaucgggcccuucaugcccggcgagguccuggugcgguuccggaccuacgugcgccaggaggccaccgccgcgcuguaccaggaccagcccaucgacugcgcccucccccaggaguucgucacgcaccuggccacccacggcuacacccugggguccgacgcccuccugcugcgguaccgcaaccuccggaccggccagcugaucugcgaggccaagcuguacgcggagggguuccuggccaucagcuacuccggcaccgggccgcuccagcugcccacggacggcguguucgagguggucagcugggugcagcgccuguaccagcucgcccccgugggcaccuccaccgccgggcggagccugggcagcuga

SEQ ID NO: 9222 - RNA, 1767 nt, Artificial Sequence
  derived and/or modified sequence opt1 from VP1_capsid_protein__Norovirus__AFV48048
augcgccugcagugggaggccuggcggagcaccuuccccggcaugcagccgcccugcguggggugcggccucgggcccucccugcugcgcccccggcgcaucguccagccguaccuccugaugcggaugagcgacgccgugcaccgcggcaacgcggccgacacccagggggccuccgccggcgagggcagcaaccuggugcccuccacggucgaccaggccauccccauccagcccguggcgggggccgccaucgccgcgccgaccgccggccaggugaaccagaucgaccccuggauccgggagaacuucguccagugcccccucggggaguucaccgugagcccccgcaacaccccgggcgaggugcuguucaaccuggcccucgggcccggccugaaccccuaccugucccaccucgccgccauguacacgggcugggucgggaacauggaggugcagcugauccuggcgggcaacgccuucaccgccgggaagguggucguggcccucaucccgcccuacuucaacaugcagacccugaccacgagccagaucacgugcuucccccacaucaugugcgacgugcggacccuggagcccauccuccugccccugcucgacguccgccggacccuguggcacccgaccaacuccgaggacgacaccaugcgccuggugugcaugcucuacacgccccugcggaccaacagccccggcgacgaguccuucguggucagcggccgccugcucucccggcccagccuggacuucaacuuccuguaccucaccccgcccaucgcccagacccccuacgagcugcccaccgugccgcgcaugauccccuccgagaugacccacagccgguggcccgcgccgaucuaccagguggucgccgaccccucccugcucgccaacccccaguggcagaacgggcgcgugacgaucgacggccagcugcuggggaccacccccaucagcuccaccugggugugcagcaucgccggcacggccgacuaccgguacaucagcggguccgacagcuucgaggagugcaagcucgcgcugucccagccgaacggcagccccuucgucgugggcgacgcccccgcccccuacggguacccggacuucuccgccaccaucagcuucuccuuccaggucgagacccgccagaacagcgccuacuccgugcgggaguucagccugaccacguccagccagaccaucaaccagucccccuacaccggcaccguguacauggaccgcagcgagacgcucgacuaccaguaccaggacgaccgcauccgcggggucccccacuccgugcacgcguuccgggaccagcugcccgacuacguggagagcggccagccgcccaaccuggccccgcccaucgggcccuucaugcccggcgagguccuccugcgguuccgcaccuacgugcggcaggaggccaccgccgcgcuguaccaggaccagcccaucgacugcgcccucccccaggaguucgugacccaccuggccacgcacggcuacacccugggguccgacgcccuccugcugcgcuaccggaaccugcgcaccggccagcucaucugcgaggccaagcuguacgcggagggguuccuggccaucagcuacuccggcaccgggccgcuccagcugcccaucgacggcgucuucgagguggugagcuggguccagcggcuguaccagcucgcccccgugggcaccagcacggccgggcgcucccuggccagcuga

SEQ ID NO: 9223 - RNA, 1623 nt, Artificial Sequence
  derived and/or modified sequence opt1 from VP1_capsid_protein__Norovirus__AGH06682
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguuccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgguccagggcauguucaugucccccgacgugaaccagagcgugcaguuccagaacgggcgcugccagaucgacggccagcugcaggggaccacccccgucucccucagccagcugugcaagauccggggcaagacguccagcaacgcccgcgugcugaaccucagcgaggucgacgggacccccuucaucccgcuggagucccccgcccccgugggcuucccggaccugggcgggugcgacuggcacgugaacuucaccuuccaggcgcagaaccaggaccccagccaguccgucaccuucgccacgaacgacgccagcuucgugcccuaccucggcuccaucagcccccacaacgggggcgacuuccacgccggggacaucaucggcucccugggcuggaucagcgccccguccgacaacagccagcugaacguguggaccauccccaaguacggguccagccuccccgacgucacccaccuggcgcccgccguguucccgcccggcuucggggaggugauccuguacuucuacuccaccuuccccggcagcgggcaguccagccagcuccagguccccugccugcugccgcaggaguucaucacgcacuucugcaacgagcaggcccccaucgccggcgaggcggcccuccugcacuacguggaccccgacaccggccggaaccugggggaguucaagcucuaccccgacggcuucaugaccugcgugccgaacuccgucagcuccgggccccagacccugcccaucaacggcguguucguguucgucagcugggugagccgcuucuaccagcugaagcccgugggcacggccuccgccgcccggcgccucgggcugcggcgcaucuga

SEQ ID NO: 9224 - RNA, 1620 nt, Artificial Sequence
  derived and/or modified sequence opt1 from VP1_capsid_protein__Norovirus__AGL98413
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucaccgccggcaaggugaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccaggcccacgacagcacccugaagcucaucgccaugcuguacacgccccugcgggcgaacaacgccggcgacgacguguucaccguguccugccgcguccucacccggcccagcccggacuucgacuucaucuuccuggugccgcccaccguggagucccgcaccaagcccuucacgguccccauccugaccguggaggagaugagcaacucccgguuccccaucccccucgagaagcuguacaccggccccagcuccgccuucgugguccagccgcagaacgggcgcugcaccacggacggcgugcugcucgggaccacccagcugagcgccgucaacaucugcaacuuccggggcgacgugacccgcgugggcacgucccacgacuacaccaugaaccuggucagccagaacuggaacaacuacgaccccaccgaggagauccccgccccgcucgggacccccgacuucgugggcaagauccaggggcugcugacgcagaccacccgggcggacggcagcacccgcgcccacaaggccacgguguccaccgggagcguccacuucacccccaagcucggcuccgugcaguucaccacggacaccgacaacgacuuccagaccggccagaacaccaaguucacgcccgugggggucauccaggacggcgaccaccaccagaacgagccgcagcagugggugcugcccaacuacagcgggaccuccggccacaacgugcaccuggcccccgccgucgcgcccgccuucccgggggagcagcuccuguucuuccggagcaccaugcccggcugcuccggcuaccccaacaugaaccuggacugccuccugccccaggagugggugcugcacuucuaccaggaggccgccccggcgcagagcgacguggcccuccugcgcuucgucaaccccgacaccgggcgggugcuguucgagugcaagcuccacaaguccggcuacaucacgguggcccacaccgggcccuacgaccuggucaucccgcccaacggcuacuuccgcuucgacagcugggugaaccaguucuacacccuggcccccauggggaacggcaccggccggcgccgggcccucuga

SEQ ID NO: 9225 - RNA, 1620 nt, Artificial Sequence
  derived and/or modified sequence opt1 from VP1_capsid_protein__Norovirus__AGL98414
augaagauggccagcuccgacgccaaccccagcgacggcuccagcgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccuguccccggaccucaaccccuaccugagccaccugucccgcauguacaacggcuacgccggcggguucgagguccaggugauccucgccggcaacgccuucaccgccgggaagaucguguucgcggccgugccgcccaacuucccgacggagggccugagccccucccaggugaccauguucccccacaucaucgucgacgugcggcagcuggagcccgugcucaucccgcugcccgacguccgcaacaacuucuaccacuacaaccaggccaacgacagcacccugaagcucaucgccaugcuguacacgccccugcgggccaacaacgcgggggacgacguguucaccguguccugccgcguccucacccggcccagcccggacuucgacuucaucuuccuggugccgcccaccguggagucccgcaccaagcccuucacgguccccgugcugaccguggaggagaugaccaacagccgguuccccaucccccucgagcgccuguucaccggccccuccacggccuucgucgugcagccgcagaacggccggugcaccaccgacgggguccugcucggcaccacgcagcugagcgccgugaacaucugcaacuuccgcggggaggugaaccacaucgccggcacccacgacuacaccaugcggcugaccucccagaacuggaacaacuacgaccccacggaggagauccccgccccgcucggcacccccgacuucgucgggcgcauccagggcgugcugacccagaccacgcggagcgacgggagcacccgcucccacaaggcgaccgugagcaccggcuccguccacuucacgcccaagcuggggagcgugcaguucaccaccgacaccacgaacgaccucaacgccggccagaacaccaaguucacccccgugggcgucgagcagaccuccggggaccaccagagcgagccgcagcaguggacgcugcccaacuacuccggcacccccaaccacaacgugcaccuggcccccgccguggccccgaccuuccccggggagcagcuccuguucuuccggagcacccugcccggcugcgggggcuaccccaacaugaaccucgacugccugcugccgcaggaguggguccuccacuucuaccaggaggcggcccccgcccaguccgacguggcccugcugcgcuucgugaaccccgacaccggccggguccucuucgagugcaagcugcaccgcagcggguucaucacgguggcgcacuccggcagccacgaccuggugaucccgcccaacggguacuuccgguucgacuccugggucaaccaguucuacacccucgcccccaugggcaacgggagcggccgccgccgggugguguga

SEQ ID NO: 9226 - RNA, 1617 nt, Artificial Sequence
  derived and/or modified sequence opt1 from VP1_capsid_protein__Norovirus__AGL98416
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccaugccccuguccccggagcucaaccccuaccugagccaccugucccgcauguacaacggcuacgccggcggguucgaggugcaggucauccucgccggcaacgccuucaccgccgggaagaucaucuucgcggccaucccgcccaacuucccgacggacggccugagccccucccaggugaccauguucccccacaucaucguggacguccggcagcuggagcccgugcucaucccgcugcccgacgugcgcaacaacuucuaccacuacaaccaggccaacgacagcacccugaagcucaucgccaugcuguacacgccccugcgggccaacaacgcgggggacgacgucuucaccguguccugccgcgugcucacccggcccagcccggacuucgacuucaucuuccuggucccgcccaccguggagucccgcaccaagcccuucacggugcccauccugaccgucgacgagaugaccaacagccgguuccccacgccccucgagaagcugcacaccggccccaacaacuccaucguggugcagccgcagaacggccgcugcaccaucgacgggguccugcucggcaccacccagcugagcacggugaacaucugcaacuuccggggguccaccacccgcgccggccagagccacgccuacaccaugaaccuggucucccagaacuggaacaacuacgaccccacggaggagauccccgccccgcucggcacccccgacuucguggggaagaucgugggcaugcugagccagaccacccgggagaacagcuccacgcgcgcccacaaggcgaccgucagcaccggggacgcccacuucacccccaaguccggcagcgugcuguucacgaccgacaccgacgaccuccagaacgggcagaacacccgguucacgcccgugggcgucgcccaggacggcgagccgcaccagaacgagccccagcaguggcgccugcccaacuacuccgggacccccggccacaacgugcaccuggccccgcccguggcccccaccuuccccggggagcagcuccuguucuuccggagcaccaugccgggcugcgggggcuaccccaacauggaccuggacugccuccugccccaggaguggguccgccacuucuaccaggaggcggcccccgcccaguccgacguggcccugcuccgguucgugaacccggacacgggccgcguccuguucgagugcaagcugcacaaggcgggguacaucaccgugagccacaccggccccuacgaccucgugaucccgcccaacggguacuuccgguucgacuccugggucaaccaguucuacgcccuggcccccaugggcaccgggaccggccgccgccgggcccuguga

SEQ ID NO: 9227 - RNA, 1629 nt, Artificial Sequence
  derived and/or modified sequence opt1 from VP1,_capsid_protein__Norovirus__BAL60749
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucucccuggagcugggccccgagcucaacccguaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacgugcccgcgccccucggcgugccggacuuccaggggcgggucuucggcgugaucucccagcgcgacaagcagaacgcggccgggcacaacgagcccgccaaccggggccacgacgccgugguccccacguacaccgcccaguacacccccaagcugggccaggugcagaucgggaccuggcagacggacgaccuccaggugaaccagccggucaaguucacccccgugggccugaacgacaccgagcacuucaaccaguggguggucccccgcuacgcgggggcccugaaccugaacaccaaccucgcccccagcguggccccgguguuccccggcgagcggcugcuguucuuccgcagcuacaucccccucaagggcggguacggcaaccccgcgaucgacugccugcugccgcaggaguggguccagcacuucuaccaggaggccgcccccuccaugagcgagguggcccucgugcgguacaucaaccccgacacggggcgcgcccuguucgaggcgaagcugcaccgggccggcuucaugaccgucuccagcaacaccuccgcccccgugguggucccggccaacggguacuuccgcuucgacagcugggugaaccaguucuacucccucgcccccaugggcaccgggaacggccggcgccgcgugcaguga

SEQ ID NO: 9228 - RNA, 1629 nt, Artificial Sequence
  derived and/or modified sequence opt1 from VP1,_capsid_protein__Norovirus__BAL60753
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcacaacucccccgggcacaacgagcccgcgaaccggggccacgacgccguggugcccacguacaccagccaguacaccccgaagcugggccagauccagaucgggaccuggcagacggacgaccugaccgucaaccagcccgugaaguucacccccgugggccucaacgacaccgagcacuucaaccagugggucgugccccgcuacgccggggcccugaaccugaacacgaaccucgccccgagcguggcgcccgucuuccccggcgagcggcugcuguucuuccgcuccuacaucccccucaagggcggguacggcaacccggccaucgacugccugcugccccaggagugggugcagcacuucuaccaggaggccgcccccagcauguccgagguggcgcucguccgguacaucaaccccgacaccgggcgcgcccuguucgaggccaagcugcaccgggccggcuucaugaccgugagcuccaacaccagcgccccgguggucgugcccgcgaacggguacuuccgcuucgacuccugggugaaccaguucuacagccucgcccccaugggcacggggaacggccggcgccgcguccaguga

SEQ ID NO: 9229 - RNA, 1629 nt, Artificial Sequence; identical to SEQ ID NO: 9228
  derived and/or modified sequence opt1 from VP1,_capsid_protein__Norovirus__BAL60755

SEQ ID NO: 9230 - RNA, 1629 nt, Artificial Sequence
  derived and/or modified sequence opt1 from VP1,_capsid_protein__Norovirus__BAL60759
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucucccuggagcugggccccgagcucaacccguaccuggcccaccuggcccgcauguacaacggccacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacgugcccgcgccccucggcgugccggacuuccaggggcgggucuucggcgugaucucccagcgcgacaagcagaacgcggccgggcacaacgagcccgccaaccggggccacgacgccgugguccccacguacaccgcccaguacacccccaagcugggccaggugcagaucgggaccuggcagacggacgaccuccaggugaaccagccggucaaguucacccccgugggccugaacgacaccgagcacuucaaccaguggguggucccccgcuacgcgggggcccugaaccugaacaccaaccucgcccccagcguggccccgguguuccccggcgagcggcugcuguucuuccgcagcuacaucccccucaagggcggguacggcaaccccgcgaucgacugccugcugccgcaggaguggguccagcacuucuaccaggaggccgcccccuccaugagcgagguggcccucgugcgguacaucaaccccgacacggggcgcgcccuguucgaggcgaagcugcaccgggccggcuucaugaccgucuccagcaacaccuccgcccccgugguggucccggccaacggguacuuccgcuucgacagcugggugaaccaguucuacucccucgcccccaugggcaccgggaacggccggcgccgcgugcaguga

SEQ ID NO: 9231 - RNA, 1629 nt, Artificial Sequence
  derived and/or modified sequence opt1 from VP1,_capsid_protein__Norovirus__BAL60767
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccaucgagaaccugagcccccagcagaucaccauguucccccacgugaucaucgacgugcggacgcucgagcccguccugcugccccucccggacgugcgcaacaacuucuuccacuacaaccagaaggacgaccccaagaugcggaucguggccaugcuguacacgccccugcgcuccaacgggagcggcgacgacgucuucaccguguccugccgggugcucacccgccccagcccggacuucgacuucaccuaccuggucccgcccaccguggaguccaagaccaagcccuucacccugcccauccucacgcugggcgagcugagcaacucccgguuccccgugagcaucgaccagauguacaccucccccaacgaggucaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacaucaccaucaccaaccugaacgggagccccuucgacccguccgaggacauccccgcgccccucggcaugccggacuuccaggggcggguguucggcaucaucagccagcgcgaccggcacaacucccccgggcacaacgagcccgcgaaccgcggccacgacgccgucgugcccacguacaccgcccaguacaccccgaagcugggccagauccagaucgggaccuggcagacggacgaccugaccgugagccagcccgucaaguucacccccgugggccucaacgacaccgagcacuucaaccaguggguggucccccgguacgccggggcccugaaccugaacacgaaccucgcgccgagcguggcccccguguuccccggcgagcgccugcuguucuuccgguccuacaucccccucaagggcggguacggcaacccggccaucgacugccugcugccccaggaguggguccagcacuucuaccaggaggccgcgcccagcauguccgagguggcccucgugcgcuacaucaaccccgacaccgggcgggcccuguucgaggccaagcugcaccgcgccggcuucaugaccgucagcuccaacaccagcgcgccgguggugguccccgccaacggguacuuccgguucgacuccugggugaaccaguucuacagccucgcccccaugggcacggggaacggccgccgccgggugcaguga

SEQ ID NO: 9232 - RNA, 1629 nt, Artificial Sequence
  derived and/or modified sequence opt1 from VP1,_capsid_protein__Norovirus__BAL60769
augaagauggccagcaacgacgccgugcccuccaccgacggcgcggccgggcuggucccggagagcaacaacgaggugauggcccucgagcccguggccggcgccgcgcuggccgcccccgucaccgggcagacgaacaucaucgaccccuggauccgcgccaacuucgugcaggcgccgaacggcgaguucaccgugagcccccggaacucccccggggagguccugcucaaccuggagcugggccccgagcucaacccguaccuggcccaccuggcccgcauguacaacggcuacgccgggggcauggagguccaggugaugcucgccgggaacgcguucaccgccggcaagcugguguucgccgccgugccgccccacuuccccguggagaaccugagcccccagcagaucaccauguucccccacgucaucaucgacgugcggacgcucgagcccgugcugcugccccucccggacguccgcaacaacuucuuccacuacaaccagaaggacgaccccaagaugcggaucguggccaugcuguacacgccccugcgcuccaacggguccggcgacgacguguucaccgucagcugccgggugcucacccgccccuccccggacuucgacuucaccuaccuggugccgcccaccgucgagagcaagaccaagcccuucacccugcccauccucacgcugggcgagcuguccaacagccgguuccccguguccaucgaccagauguacaccagccccaacgaggugaucuccguccagugccagaacgggcgcugcacccucgacggcgagcugcaggggaccacgcagcugcaggucagcggcaucugcgcguucaagggcgaggugaccgcccaccuccacgacaacgagcaccuguacaacgugaccaucaccaaccugaacgggucccccuucgacccgagcgaggacauccccgcgccccucggcgugccggacuuccaggggcgggucuucggcgugaucucccagcgcgacaagcacaacacgcccgggcacaacgagcccgccaaccgggcccacgacgccgugguccccaccuacaccgcccaguacaccccgaagcugggccaggugcagaucggcacguggcagaccgacgaccugaccgacaaccagcccgugaaguucacccccgucgggcucaacgacacggagcacuucaaccaguggguggugccccgcuacgccggcgcccugaaccugaacaccaaccucgccccgagcgucgcgcccguguuccccggggagcggcugcuguucuuccgcagcuacaucccccucaagggcggguacggcaccccggccaucgacugccugcugccccaggagugggugcagcacuucuaccaggaggccgcccccuccaugagcgaggucgcgcucgugcgguacaucaaccccgacaccggccgcgcccuguucgaggccaagcugcaccgggccggguucaugacgguguccagcaacaccuccgccccggucguggugcccgcgaacggcuacuuccgcuucgacagcugggucaaccaguucuacucccucgcccccauggggaccggcaacgggcggcgccgcauccaguga

SEQ ID NO: 9233 - RNA, 1629 nt, Artificial Sequence
  derived and/or modified sequence opt1 from VP1,_capsid_protein__Norovirus__BAL60771
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacaucaccaucaccaaccugaacgggagccccuucgacccguccgaggacauccccgcgccccucggcgucccggacuuccaggggcggguguucggcaucaucagccagcgcgacaagcacaacucccccgggcacaacgagcccgcgaaccggggccacgacgccgugguccccacguacaccgcccaguacaccccgaagcugggccagauccagaucgggaccuggcagacggacgaccugaccgugagccagcccgugaaguucacccccgucggccucaacgacaccgagcacuucaaccaguggguggugccccgcuacgccggggcccugaaccugaacacgaaccucgcgccgagcgucgcccccguguuccccggcgagcggcugcuguucuuccgcuccuacaucccccucaagggcggguacggcaacccggccaucgacugccugcugccccaggagugggugcagcacuucuaccaggaggccgcgcccagcauguccgaggucgcccucgugcgguacaucaaccccgacaccgggcgcgcccuguucgaggccaagcugcaccgggccggcuucaugaccgugagcuccaacaccagcgcgccggucguggugcccgccaacggguacuuccgcuucgacuccugggucaaccaguucuacagccucgcccccaugggcacggggaacggccggcgccgcgugcaguga

SEQ ID NO: 9234 - RNA, 1629 nt, Artificial Sequence
  derived and/or modified sequence opt1 from VP1,_capsid_protein__Norovirus__BAL60773
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcaucaucagccagcgcgacaagcacaacucccccgggcacaacgagcccgcgaaccggggccacgacgccgucgugcccacguacaccgcccaguacaccccgaagcugggccagauccagaucgggaccuggcagacggacgaccugaccgugaaccagcccgucaaguucacccccgugggccucaacgacaccgagcacuucaaccaguggguggucccccgcuacgccggggcccugaaccugaacacgaaccucgcgccgagcguggcccccguguuccccggcgagcggcugcuguucuuccgcagcuacaucccccucaagggcggguacggcaacccggccaucgacugccugcugccccaggaguggguccagcacuucuaccaggaggccgcgcccuccaugagcgagguggcccucgugcgguacaucaaccccgacaccgggcgcgcccuguucgaggccaagcugcaccgggccggcuucaugaccgucuccagcaacaccuccgcgccgguggugguccccgccaacggguacuuccgcuucgacagcugggugaaccaguucuacucccucgcccccaugggcacggggaacggccggcgccgcgugcaguga

SEQ ID NO: 9235 - RNA, 1629 nt, Artificial Sequence
  derived and/or modified sequence opt1 from VP1,_capsid_protein__Norovirus__BAL60775
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccaucgagaaccugagcccccagcagaucaccauguucccccacgugaucaucgacgugcggacgcucgagcccguccugcugccccucccggacgugcgcaacaacuucuuccacuacaaccagaaggacgaccccaagaugcggaucguggccaugcuguacacgccccugcgcuccaacgggagcggcgacgacgucuucaccguguccugccgggugcucacccgccccagcccggacuucgacuucaccuaccuggucccgcccaccguggaguccaagaccaagcccuucacccugcccauccucacgcugggcgagcugagcaacucccgguuccccgugagcaucgaccagauguacaccucccccaacgaggucaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacaucaccaucaccaaccugaacgggagccccuucgacccguccgaggacauccccgcgccccucggcgugccggacuuccaggggcgggucuucggcaucaucagccagcgcgacaagcacaacucccccgggcacaacgagcccgcgaaccggggccacgacgccguggugcccacguacaccgcccaguacaccccgaagcugggccagauccagaucgggaccuggcagacggacgaccugaccgucagccagcccgugaaguucacccccgugggccucaacgacaccgagcacuucaaccagugggucgugccccgcuacgccggggcccugaaccugaacacgaaccucgcgccgagcguggcccccgucuuccccggcgagcggcugcuguucuuccgcuccuacaucccccucaagggcggguacggcaacccggccaucgacugccugcugccccaggagugggugcagcacuucuaccaggaggccgcgcccagcauguccgagguggcccucguccgguacaucaaccccgacaccgggcgcgcccuguucgaggccaagcugcaccgggccggcuucaugaccgugagcuccaacaccagcgcgccgguggucgugcccgccaacggguacuuccgcuucgacuccugggugaaccaguucuacagccucgcccccaugggcacggggaacggccggcgccgcguccaguga

SEQ ID NO: 9236 - RNA, 1629 nt, Artificial Sequence; identical to SEQ ID NO: 9235
  derived and/or modified sequence opt1 from VP1,_capsid_protein__Norovirus__BAL60777

SEQ ID NO: 9237 - RNA, 1629 nt, Artificial Sequence; identical to SEQ ID NO: 9235
  derived and/or modified sequence opt1 from VP1,_capsid_protein__Norovirus__BAL60779

SEQ ID NO: 9238 - RNA, 1629 nt, Artificial Sequence
  derived and/or modified sequence opt1 from VP1,_capsid_protein__Norovirus__BAL60781
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcaucgucagccagcgcgacaagcacaacucccccgggcacaacgagcccgcgaaccggggccacgacgccguggugcccacguacaccgcccaguacaccccgaagcugggccagauccagaucgggaccuggcagacggacgaccugaccgucaaccagcccgugaaguucacccccgugggccucaacgacaucgagcacuucaaccagugggucgugccccgcuacgccggggcccugaaccugaacaccaaccucgcgccgagcguggcccccgucuuccccggcgagcggcugcuguucuuccgcagcuacaucccccucaagggcggguacggcaacccggccaucgacugccugcugccccaggagugggugcagcacuucuaccaggaggccgcgcccuccaugagcgagguggcccucguccgguacaucaaccccgacacggggcgcgcccuguucgaggccaagcugcaccgggccggcuucaugaccguguccagcaacaccuccgcgccgguggucgugcccgccaacggguacuuccgcuucgacagcugggugaaccaguucuacucccucgcccccaugggcaccgggaacggccggcgccgcguccaguga

SEQ ID NO: 9239 - RNA, 1629 nt, Artificial Sequence
  derived and/or modified sequence opt1 from VP1,_capsid_protein__Norovirus__BAL60783
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgagcaccuguacaacgucaccaucaucaaccugaacgggucccccuucgacccgagcgaggacauccccgcgccccucggcgugccggacuuccaggggcggguguucggcgucaucucccagcgcgacaagcacaacacccccgggcacaacgagcccgccaaccgggcccacgacgccguggugcccacguacaccgcccaguacaccccgaagcugggccagauccagaucggcaccuggcagacggacgaccugaccaacaaccagcccgucaaguucacccccguggggcucaacgacaccgagcacuucgaccaguggguggucccccgcuacgccggcgcccugaaccugaacacgaaccucgcgccgagcguggcccccguguuccccggggagcggcugcuguucuuccgcagcuacaucccccucaagggcggguacggcaccccggccaucgacugccugcugccccaggaguggguccagcacuucuaccaggaggccgcgcccuccaugagcgagguggcccucgugcgguacaucaaccccgacaccggccgcgcccuguucgaggccaagcugcaccgggccggguucaugaccgucuccagcaacacguccgcgccgguggugguccccgccaacggcuacuuccgcuucgacagcugggugaaccaguucuacucccucgcccccauggggaccggcaacgggcggcgccgcauccaguga

SEQ ID NO: 9240 - RNA, 1629 nt, Artificial Sequence
  derived and/or modified sequence opt1 from VP1,_capsid_protein__Norovirus__BAL60785
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccaucgagaaccugagcccccagcagaucaccauguucccccacgugaucaucgacgugcggacgcucgagcccguccugcugccccucccggacgugcgcaacaacuucuuccacuacaaccagaaggacgaccccaagaugcggaucguggccaugcuguacacgccccugcgcuccaacgggagcggcgacgacgucuucaccguguccugccgggugcucacccgccccagcccggacuucgacuucaccuaccuggucccgcccaccguggaguccaagaccaagcccuucacccugcccauccucacgcugggcgagcugagcaacucccgguuccccgugagcaucgaccagauguacaccucccccaacgaggucaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgugaccaucaccaaccugaacgggagccccuucgacccguccgaggacauccccgcgccccucggcgucccggacuuccaggggcggguguucggcaucaucagccagcgcgacaagcacaacucccccgggcagaacgagcccgcgaaccggggccacgacgccgugguccccacguacaccgcccaguacaccccgaagcugggccagauccagaucgggaccuggcagacggacgaccugaccgugagccagcccgugaaguucacccccgucggccucaacgacaccgagcacuucaaccaguggguggugccccgcuacgccggggcccugaaccugaacacgaaccucgcgccgagcgucgcccccguguuccccggcgagcggcugcuguucuuccgcuccuacaucccccucaagggcggguacggcaacccggccaucgacugccugcugccccaggagugggugcagcacuucuaccaggaggccgcgcccagcauguccgaggucgcccucgugcgguacaucaaccccgacaccgggcgcgcccuguucgaggccaagcugcaccgggccggcuucaugaccgugagcuccaacaccagcgcgccggucguggugcccgccaacggguacuuccgcuucgacuccugggucaaccaguucuacagccucgcccccaugggcacggggaacggccggcgccgcgugcaguga

SEQ ID NO: 9241 - RNA, 1629 nt, Artificial Sequence; identical to SEQ ID NO: 9235
  derived and/or modified sequence opt1 from VP1,_capsid_protein__Norovirus__BAL60791

SEQ ID NO: 9242 - RNA, 1629 nt, Artificial Sequence; identical to SEQ ID NO: 9235
  derived and/or modified sequence opt1 from VP1,_capsid_protein__Norovirus__BAL60793

SEQ ID NO: 9243 - RNA, 1629 nt, Artificial Sequence; identical to SEQ ID NO: 9235
  derived and/or modified sequence opt1 from VP1,_capsid_protein__Norovirus__BAL60795

SEQ ID NO: 9244 - RNA, 1629 nt, Artificial Sequence; identical to SEQ ID NO: 9235
  derived and/or modified sequence opt1 from VP1,_capsid_protein__Norovirus__BAL60797

SEQ ID NO: 9245 - RNA, 1629 nt, Artificial Sequence
  derived and/or modified sequence opt1 from VP1,_capsid_protein__Norovirus__BAL60799
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccgucaaccagcccgugaacuucacccccgccgggcucagcgacacggaccacuucaaccaguggguggucccccgcuacgccggcgcgcugaaccugaacaccaaccucgccccgagcguggcccccguguuccccggggagcggcugcuguucuuccgcuccuacaucccccucaagggcggguacggcaccccggccaucgacugccugcugccccaggaguggguccagcacuucuaccaggaggcggcccccagcauguccgagguggcccucgugcgguacaucaaccccgacaccggccgcgcccuguucgaggccaagcugcaccgggcgggguucaugacggucagcuccaacaccagcgccccgguggugguccccgccaacggcuacuuccgcuucgacuccugggugaaccaguucuacagccucgcccccauggggaccggcaacgggcggcgccgcauccaguga

SEQ ID NO: 9246 - RNA, 1629 nt, Artificial Sequence; identical to SEQ ID NO: 9235
  derived and/or modified sequence opt1 from VP1,_capsid_protein__Norovirus__BAL60801

SEQ ID NO: 9247 - RNA, 1629 nt, Artificial Sequence; identical to SEQ ID NO: 9235
  derived and/or modified sequence opt1 from VP1,_capsid_protein__Norovirus__BAL60803

SEQ ID NO: 9248 - RNA, 1629 nt, Artificial Sequence
  derived and/or modified sequence opt1 from VP1,_capsid_protein__Norovirus__BAL60805
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggccacgccgggggcauggagguccaggugaugcucgccgggaacgccuucaccgccggcaagcugguguucgccgcggucccgccccacuuccccaucgagaaccugagcccccagcagaucaccauguucccccacgugaucaucgacgugcggacgcucgagcccguccugcugccccucccggacgugcgcaacaacuucuuccacuacaaccagaaggacgaccccaagaugcggaucguggccaugcuguacacgccccugcgcuccaacgggagcggcgacgacgucuucaccguguccugccgggugcucacccgccccagcccggacuucgacuucaccuaccuggucccgcccaccguggaguccaagaccaagcccuucacccugcccauccucacgcugggcgagcugagcaacucccgguuccccgugagcaucgaccagauguacaccucccccaacgaggucaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacaucaccaucaccaaccugaacgggagccccuucgacccguccgaggacauccccgcgccccucggcgugccggacuuccaggggcgggucuucggcaucaucagccagcgcgacaagcacaacucccccgggcacaacgagcccgcgaaccggggccacgacgccguggugcccacguacaccgcccaguacaccccgaagcugggccagauccagaucgggaccuggcagacggacgaccugaccgucagccagcccgugaaguucacccccgugggccucaacgacaccgagcacuucaaccagugggucgugccccgcuacgccggggcccugaaccugaacacgaaccucgcgccgagcguggcccccgucuuccccggcgagcggcugcuguucuuccgcuccuacaucccccucaagggcggguacggcaacccggccaucgacugccugcugccccaggagugggugcagcacuucuaccaggaggccgcgcccagcauguccgagguggcccucguccgguacaucaaccccgacaccgggcgcgcccuguucgaggccaagcugcaccgggccggcuucaugaccgugagcuccaacaccagcgcgccgguggucgugcccgccaacggguacuuccgcuucgacuccugggugaaccaguucuacagccucgcccccaugggcacggggaacggccggcgccgcguccaguga

SEQ ID NO: 9249 - RNA, 1629 nt, Artificial Sequence
  derived and/or modified sequence opt1 from VP1,_capsid_protein__Norovirus__BAL60809
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccgucaaccagcccgugaacuucacccccguggggcucagcgacacggaccacuucaaccagugggucgugccccgcuacgccggcgcccugaaccugaacaccaaccucgcgccgagcguggcccccgucuuccccggggagcggcugcuguucuuccgcuccuacaucccccucaagggcggguacggcaccccggccaucgacugccugcugccccaggagugggugcagcacuucuaccaggaggccgcgcccagcauguccgagguggcccucguccgguacaucaaccccgacaccggccgcgcccuguucgaggccaagcugcaccgggccggguucaugacggugagcuccaacaccagcgcgccgguggucgugcccgccaacggcuacuuccgcuucgacuccugggugaaccaguucuacagccucgcccccauggggaccggcaacgggcggcgccgcauccaguga

SEQ ID NO: 9250 - RNA, 1629 nt, Artificial Sequence
  derived and/or modified sequence opt1 from VP1,_capsid_protein__Norovirus__BAL60811
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacaucaccaucaccaaccugaacgggagccccuucgacccguccgaggacauccccgcgccccucggcgucccggacuuccaggggcggguguucggcaucaucagccagcgcgacaagcacaacucccccgggcacaacgagcccgcgaaccggggccacgacgccgugguccccacguacaccgcccaguacaccccgaagcugggccagauccagaucgggaccuggcagacggacgaccugaccgugagccagcccgugaaguucacccccgucggccucaacgacaccgagcacuucaaccaguggguggugccccgcuacgccggggcccugaaccugaacacgaaccucgcgccgagcgucgcccccguguuccccggcgagcggcugcuguucuuccgcuccuacaucccccucaagggcggguacggcgacccggccaucgacugccugcugccccaggagugggugcagcacuucuaccaggaggccgcgcccagcauguccgaggucgcccucgugcgguacaucaaccccgacaccgggcgcgcccuguucgaggccaagcugcaccgggccggcuucaugaccgugagcuccaacaccagcgcgccggucguggugcccgccaacggguacuuccgcuucgacuccugggucaaccaguucuacagccucgcccccaugggcacggggaacggccggcgccgcgugcaguga

SEQ ID NO: 9251 - RNA, 1629 nt, Artificial Sequence; identical to SEQ ID NO: 9250
  derived and/or modified sequence opt1 from VP1,_capsid_protein__Norovirus__BAL60813

SEQ ID NO: 9252 - RNA, 1629 nt, Artificial Sequence; identical to SEQ ID NO: 9249
  derived and/or modified sequence opt1 from VP1,_capsid_protein__Norovirus__BAL60815

SEQ ID NO: 9253 - RNA, 1629 nt, Artificial Sequence
  derived and/or modified sequence opt1 from VP1,_capsid_protein__Norovirus__BAL60817
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccaucgagaaccugagcccccagcagaucaccauguucccccacgugaucaucgacgugcggacgcucgagcccguccugcugccccucccggacgugcgcaacaacuucuuccacuacaaccagaaggacgaccccaagaugcggaucguggccaugcuguacacgccccugcgcuccaacgggagcggcgacgacgucuucaccguguccugccgggugcucacccgccccagcccggacuucgacuucaccuaccuggucccgcccaccguggaguccaagaccaagcccuucacccugcccauccucacgcugggcgagcugagcaacucccgguuccccgugagcaucgaccagauguacaccucccccaacgaggucaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacaucaccaucaccaaccugaacgggagccccuucgacccguccgaggacauccccgcgccccucggcgugccggacuuccaggggcgggucuucggcaucaucagccagcgcgacaagcacaacucccccgggcacaacgagcccgcgaaccggggccacgacgccguggugcccacguacaccgcccaguacaccccgaagcugggccagauccagaucgggaccuggcagacggacgaccugaccgucagccagcccgugaaguucgcccccgugggccucaacgacaccgagcacuucaaccagugggucgugccccgcuacgccggggcgcugaaccugaacaucaaccucgccccgagcguggcccccgucuuccccggcgagcggcugcuguucuuccgcuccuacaucccccucaagggcggguacggcaacccggccaucgacugccugcugccccaggagugggugcagcacuucuaccaggaggcggcccccagcauguccgagguggcccucguccgguacaucaaccccgacaccgggcgcgcccuguucgaggccaagcugcaccgggcgggcuucaugacggugagcuccaacaccagcgccccgguggucgugcccgccaacggguacuuccgcuucgacuccugggugaaccaguucuacagccucgcccccaugggcaccgggaacggccggcgccgcguccaguga

SEQ ID NO: 9254 - RNA, 1629 nt, Artificial Sequence; identical to SEQ ID NO: 9235
  derived and/or modified sequence opt1 from VP1,_capsid_protein__Norovirus__BAL60819

SEQ ID NO: 9255 - RNA, 1629 nt, Artificial Sequence; identical to SEQ ID NO: 9235
  derived and/or modified sequence opt1 from VP1,_capsid_protein__Norovirus__BAL60821

SEQ ID NO: 9256 - RNA, 1629 nt, Artificial Sequence
  derived and/or modified sequence opt1 from VP1,_capsid_protein__Norovirus__BAL60823
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggccucgagguccaggugaugcuggccgggaacgccuucaccgccggcaagcugguguucgccgcggucccgccccacuuccccaucgagaaccucagcccccagcagaucaccauguucccccacgugaucaucgacgugcggacgcuggagcccguccugcucccccugccggacgugcgcaacaacuucuuccacuacaaccagaaggacgaccccaagaugcggaucguggccaugcuguacacgccccuccgcuccaacgggagcggcgacgacgucuucaccguguccugccgggugcugacccgccccagcccggacuucgacuucaccuaccuggucccgcccaccguggaguccaagaccaagcccuucacccuccccauccugacgcugggcgagcucagcaacucccgguuccccgugagcaucgaccagauguacaccucccccaacgaggucaucagcgugcagugccagaacgggcgcugcacccuggacggcgagcugcaggggaccacgcagcuccagguguccggcaucugcgccuucaagggcgaggucaccgcccaccuccacgacaacgaccaccuguacaacaucaccaucaccaaccucaacgggagccccuucgacccguccgaggacauccccgcgccccugggcgugccggacuuccaggggcgggucuucggcaucaucagccagcgcgacaagcacaacucccccgggcacaacgagcccgcgaaccggggccacgacgccguggugcccacguacaccgcccaguacaccccgaagcugggccagauccagaucgggaccuggcagacggacgaccucaccgucagccagcccgugaaguucacccccgugggccugaacgacaccgagcacuucaaccagugggucgugccccgcuacgccggggcccugaaccucaacacgaaccuggcgccgagcguggcccccgucuuccccggcgagcggcugcuguucuuccgcuccuacaucccccugaagggcggguacggcaacccggccaucgacugccugcucccccaggagugggugcagcacuucuaccaggaggccgcgcccagcauguccgagguggcccugguccgguacaucaaccccgacaccgggcgcgcccuguucgaggccaagcuccaccgggccggcuucaugaccgugagcuccaacaccagcgcgccgguggucgugcccgccaacggguacuuccgcuucgacuccugggugaaccaguucuacagccuggcccccaugggcacggggaacggccggcgccgcguccaguga

SEQ ID NO: 9257 - RNA, 1629 nt, Artificial Sequence
  derived and/or modified sequence opt1 from VP1,_capsid_protein__Norovirus__BAL60825
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaaguccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgaccccuccgaggacaucccggcgccccucggcgugcccgacuuccaggggcggguguucggcgucaucagccagcgcgacaagcacaacacgccggggcacaacgagcccgccaaccgggcccacgacgccguggugcccaccuacaccgcccaguacacccccaagcugggccagauccagaucggcacguggcagaccgacgaccugaccgucaaccagccggugaacuucacccccguggggcucagcgacacggaccacuucaaccagugggucgugccccgcuacgccggcgcccugaaccugaacaccaaccucgcgcccuccguggccccggucuuccccggggagcggcugcuguucuuccgcagcuacaucccccucaagggcggguacggcacccccgccaucgacugccugcugccgcaggagugggugcagcacuucuaccaggaggccgcgcccuccaugagcgagguggcccucguccgguacaucaaccccgacaccggccgcgcccuguucgaggccaagcugcaccgggccggguucaugacgguguccagcaacaccuccgcgcccguggucgugccggccaacggcuacuuccgcuucgacagcugggugaaccaguucuacucccucgcccccauggggaccggcaacgggcggcgccgcauccaguga

SEQ ID NO: 9258 - RNA, 1629 nt, Artificial Sequence; identical to SEQ ID NO: 9235
  derived and/or modified sequence opt1 from VP1,_capsid_protein__Norovirus__BAL60827

SEQ ID NO: 9259 - RNA, 1629 nt, Artificial Sequence; identical to SEQ ID NO: 9235
  derived and/or modified sequence opt1 from VP1,_capsid_protein__Norovirus__BAL60829

SEQ ID NO: 9260 - RNA, 1629 nt, Artificial Sequence; identical to SEQ ID NO: 9235
  derived and/or modified sequence opt1 from VP1,_capsid_protein__Norovirus__BAL60831

SEQ ID NO: 9261 - RNA, 1629 nt, Artificial Sequence
  derived and/or modified sequence opt1 from VP1,_capsid_protein__Norovirus__BAL60833
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccgucaaccagcccgugaacuucacccccguggggcucaacgacacggaccacuucaaccagugggucgugccccgcuacgccggcgcccugaaccugaacaccaaccucgcgccgagcguggcccccgucuuccccggggagcggcugcuguucuuccgcagcuacaucccccucaagggcggguacggcaccccggccaucgacugccugcugccccaggagugggugcagcacuucuaccaggaggccgcgcccuccaugagcgagguggcccucguccgguacaucaaccccgacaccggccgcgcccuguucgaggccaagcugcaccgggccggguucaugacgguguccagcaacaccuccgcgccgguggucgugcccgccaacggcuacuuccgcuucgacagcugggugaaccaguucuacucccucgcccccauggggaccggcaacgggcggcgccgcauccaguga

SEQ ID NO: 9262 - RNA, 1629 nt, Artificial Sequence
  derived and/or modified sequence opt1 from VP1,_capsid_protein__Norovirus__BAL60835
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccgucaaccagcccgccaacuucacccccguggggcucagcgacacggaccacuucaaccaguggguggucccccgcuacgccggcgcgcugaaccugaacaccaaccucgccccgagcguggcccccguguuccccggggagcggcugcuguucuuccgcuccuacaucccccucaagggcggguacggcaccccggccaucgacugccugcugccccaggaguggguccagcacuucuaccaggaggcggcccccagcauguccgagguggcccucgugcgguacaucaaccccgacaccggccgcgcccuguucgaggccaagcugcaccgggcgggguucaugacggucagcuccaacaccagcgccccgguggugguccccgccaacggcuacuuccgcuucgacuccugggugaaccaguucuacagccucgcccccauggggaccggcaacgggcggcgccgcauccaguga

SEQ ID NO: 9263 - RNA, 1629 nt, Artificial Sequence; identical to SEQ ID NO: 9249
  derived and/or modified sequence opt1 from VP1,_capsid_protein__Norovirus__BAL60837

SEQ ID NO: 9264 - RNA, 1629 nt, Artificial Sequence; identical to SEQ ID NO: 9249
  derived and/or modified sequence opt1 from VP1,_capsid_protein__Norovirus__BAL60839

SEQ ID NO: 9265 - RNA, 1629 nt, Artificial Sequence
  derived and/or modified sequence opt1 from VP1,_capsid_protein__Norovirus__BAL60841
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccgucaaccagcccgugaaguucacccccguggggcucaacgacacggaccacuucaaccagugggucgugccccgcuacgccggcgcccugaaccugaacaccaaccucgcgccgagcguggcccccgucuuccccggggagcggcugcuguucuuccgcagcuacaucccccucaagggcggguacggcaccuccgccaucgacugccugcugccgcaggagugggugcagcacuucuaccaggaggccgcgcccagcauguccgagguggcccucguccgguacaucaaccccgacaccggccgcgcccuguucgaggccaagcugcaccgggccggguucaugacggugagcuccaacaccagcgcgcccguggucgugccggccaacggcuacuuccgcuucgacuccugggugaaccaguucuacagccucgcccccauggggaccggcaacgggcggcgccgcauccaguga

SEQ ID NO: 9266 - RNA, 1629 nt, Artificial Sequence; identical to SEQ ID NO: 9235
  derived and/or modified sequence opt1 from VP1,_capsid_protein__Norovirus__BAL60843

SEQ ID NO: 9267 - RNA, 1629 nt, Artificial Sequence; identical to SEQ ID NO: 9261
  derived and/or modified sequence opt1 from VP1,_capsid_protein__Norovirus__BAL60845

SEQ ID NO: 9268 - RNA, 1629 nt, Artificial Sequence; identical to SEQ ID NO: 9249
  derived and/or modified sequence opt1 from VP1,_capsid_protein__Norovirus__BAL60847

SEQ ID NO: 9269 - RNA, 1629 nt, Artificial Sequence
  derived and/or modified sequence opt1 from VP1,_capsid_protein__Norovirus__BAL60849
augaagauggccagcaacgacgccgcgcccuccaccgacggcgccgccgggcuggugccggagagcaacuccgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucaaccuggagcugggccccgagcucaacccguaccuggcccaccuggcccgcauguacaacggcuacgccgggggcauggagguccaggugaugcucgccgggaacgccuucaccgccggcaagcugguguucgccgcggucccgccccacuuccccaucgagaaccugagcccccagcagaucaccauguucccccacgugaucaucgacgugcggacgcucgagcccguccugcugccccucccggacgugcgcaacaacuucuuccacuacaaccagaaggacgaccccaagaugcggaucguggccaugcuguacacgccccugcgcuccaacggguccggcgacgacgucuucaccgugagcugccgggugcucacccgccccuccccggacuucgacuucaccuaccuggucccgcccaccguggagagcaagaccaagcccuucacccugcccauccucacgcugggcgagcuguccaacagccgguuccccguguccaucgaccagauguacaccagccccaacgaggucaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacaucaccaucaccaaccugaacgggucccccuucgacccgagcgaggacauccccgcgccccucggcgugccggacuuccaggggcgggucuucggcaucaucucccagcgcgacaagcacaacagccccgggcacaacgagcccgcgaaccggggccacgacgccguggugcccacguacaccgcccaguacaccccgaagcugggccagauccagaucgggaccuggcagacggacgaccugaccgucagccagcccgugaaguucacccccgugggccucaacgacaccgagcacuucaaccagugggucgugccccgcuacgccggggcccugaaccugaacacgaaccucgcgccguccguggcccccgucuuccccggcgagcggcugcuguucuuccgcagcuacaucccccucaagggcggguacggcaacccggccaucgacugccugcugccccaggagugggugcagcacuucuaccaggaggccgcgcccuccaugagcgagguggcccucguccgguacaucaaccccgacaccgggcgcgcccuguucgaggccaagcugcaccgggccggcuucaugaccguguccagcaacaccuccgcgccgguggucgugcccgccaacggguacuuccgcuucgacagcugggugaaccaguucuacucccucgcccccaugggcacggggaacggccggcgccgcguccaguga

SEQ ID NO: 9270 - RNA, 1629 nt, Artificial Sequence; identical to SEQ ID NO: 9235
  derived and/or modified sequence opt1 from VP1,_capsid_protein__Norovirus__BAL60851

SEQ ID NO: 9271 - RNA, 1647 nt, Artificial Sequence
  derived and/or modified sequence opt1 from VP1__Norovirus__AAT00378
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucacggugagcugccgggugcugacccgccccucccccgacuucagcuucaacuuccuggugcccccgaccguggaguccaagaccaagcccuucacgcuccccauccugaccaucagcgagauguccaacagccgguuccccgugccgaucgacucccugcacaccagccccaccgagaacaucgucgugcagugccagaacgggcgcgugacgcucgacggcgagcugauggggaccacccagcugcuccccucccagaucugcgccuuccggggcguccugacccgcagcacgucccgggccagcgaccaggcggacaccgugacgccccgccuguucaacuacuacuggcacauccagcucgacaaccugaacggcaccccguacgaccccgccgaggacauccccgggccgcugggcacgcccgacuuccgggggaagguguucggcgucgccagccagcgcaaccccgacuccaccacccgggcccacgaggccaagguggacaccacggcggggcgcuucacccccaagcucggcagccuggagaucuccaccgagagcgacgacuucgaccagaaccagccgacccgguucgcccccgucggcaucgggguggaccgcgaggccggcuuccagcaguggucccugcccgacuacagcgggcaguucucccggaucaugagccucgcccccgcgguggccccgaucuuccccggcgagcagcugcuguucuuccgcucccagcuccccagcuccgggggccgcagcaacggcauccuggacugccuggucccccaggagugggugcagcacuucuaccaggaguccgccccggcccagacccagguggcccucguccgguacgugaaccccgacaccgggcgcgugcuguucgaggcgaagcugcacaagcucggcuucaugaccaucgccaagaacggggacagccccaucaccgugcccccgaacggcuacuuccgguucgaguccugggucaaccccuucuacacgcuggcccccauggggaccggcaacggccgccggcgcauccaguga

SEQ ID NO: 9272 - RNA, 1626 nt, Artificial Sequence
  derived and/or modified sequence opt1 from VP1__Norovirus__ABD95934
augaagauggccagcaacgacgccgcgcccuccaacgacggcgccgccgggcuggugccggagaucaacaccgagacccucccccuggagcccgucgccggcgccgcgcuggccgccgccgugacggggcagagcaacaucaucgaccccuggauccgcaccaacuucgugcaggcgccgaacggcgaguucaccgucagcccccggaacucccccggggaggugcuccugaaccuggagcucggccccgaccugaacccguaccuggcccaccucucccgcauguacaacggcuacgccgggggcguggagguccaggugcugcuggccgggaacgccuucaccgcgggcaagauccucuucgccgccgugccgcccaacuuccccgucgaguuccugagccccgcccagaucacgaugcugccccaccucaucguggacgugcggacccuggagcccaucaugaucccccugccggacguccgcaacaccuucuuccacuacaacaaccggcccuccgagcgcaugcggcucguggccaugcuguacacgccccugcgcagcaacggguccggcgacgacguguucaccgucagcugccgggugcucacccgccccaccccggacuucgaguucaccuaccuggugccgcccuccgucgagagcaagacgaagcccuucucccugcccauccucaccaucagcgagcugaccaacucccgguuccccgcgcccaucgacagccuguucaccgcccagaacaacaaccucaacgugcagugccagaacggccgcugcacgcuggacggggagcugcagggcaccacccagcuccugcccaccgggaucugcgccuuccggggcaagaucuccgccgacgugcagaacagccaccaggaccgcuggcacaugcagcugacgaaccucaacggcaccccguucgaccccaccgacgacguccccgccccgcuggggacccccgacuucacgggccuccuguucgggguggcgucccagcggaacgugggcgggaccggcaacaacaccacccgcgcccacgaggucgugaucgccacgaccagcacccaguucguccccaagcugggcagcaucaacuucggguccgagagcgaggacuuccagguggggcccccgaccaaguucacgcccgugggcaucaagaucgagaccggccacuccuuccggcagugggacccgcccaacuacagcggggcccugacccucaacaugaaccuggccccgcccgucgcgcccaacuuccccggcgagcagcuccuguucuuccgcuccaacgugcccugcgccggcggggugagcgagggcaucaucgacugccugcugccccaggaguggauccagcacuucuaccaggaguccgcccccagccaguccgacgucgcccucauccgguacgugaaccccgacaccgggcgcacgcuguucgaggcgaagcugcaccggaccggcuacaucaccguggcccacagcggggacuacccgcucgucgugcccuccaacggcuacuuccgcuucgacagcuggaucaaccaguucuacucccuggcccccaugggcaccgggaacggccgccggcgcgugcaguga

SEQ ID NO: 9273 - RNA, 1623 nt, Artificial Sequence
  derived and/or modified sequence opt1 from VP1__Norovirus__ABG49509
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgacacccacaacuacacgaugaaccuggccucccagaacuggaacaacuacgacccgaccgaggagauccccgcgccccuggggacccccgacuucgugggcaagauccaggggaugcucacccagacgacccgcggcgacgggagcacccggggccacaaggccaccgucuccacgggcgacgugcacuucaccccgaagcuggggagcauccaguucaacaccgacaccaacaacgacuucgagacgggccagaacaccaaguucacccccgugggggucgugcaggacggcaacgggacccaccagaacgagccccagcagugggugcugcccuccuacagcggccgcacgggccacaacguccaccucgccccggccguggcccccaccuuccccggggagcagcugcuguucuuccggagcaccaugcccggcugcuccggguacccgaacaugaaccucgacugccugcugccccaggagugggugcagcacuucuaccaggaggccgcgcccgcccagagcgacgucgcccuccugcgcuucgugaaccccgacaccggccgggugcuguucgagugcaagcuccacaaguccggguacgucaccguggcccacacgggccagcacgaccuggugaucccgcccaacggcuacuuccgcuucgacagcugggucaaccaguucuacacccuggcgcccauggggaacggcaccgggcggcgccgggcccucuga

SEQ ID NO: 9274 - RNA, 1623 nt, Artificial Sequence
  derived and/or modified sequence opt1 from VP1__Norovirus__ABP88833
augaagauggccaccaacgacgccagccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgagguggaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcaccaagcccuucaccguccccauccugaccguggaggagaugacgaacucccgguuccccaucccccuggagaagcuguucaccggccccagcuccgcccucgugguccagccgcagaacgggcgcugcaccaccgacggcgugcugcucgggacgacccagcugagccccgucaacaucugcaccuuccggggcgacgugacccacaucuccggcacgcgcaccuaccggaugaaccuggccagccagaacuggaacaacuacgaccccaccgaggagaucccggcgccccucgggacccccgacuucgugggcaagauccaggggaugcugacgcagaccaccaagggcgacggguccacccgcggccacaaggccacggucagcaccggcagcguggacuucacccccaagcugggguccgugcaguucgccaccgacacggacaacgacuucgagaccggccagaacacccgguucaccccggucggggugauccaggacggcagcuccgcccaccgcaacgagccccagcagugggugcuccccgacuacagcgggcggacgguccacaacgugcaccuggcccccgccguggccccgaccuuccccggcgagcagcugcccuucuuccgcuccaccaugcccggcugcagcggguacccgaacauggaccucgacugccugcugccccaggaguggguccagcacuucuaccaggaggcggcccccucccagagcgacguggcccuccugcgguucgugaaccccgacaccggccgcguccuguucgagugcaagcuccacaaggccggguacgugaccguggcgcacacgggccagcacgaccuggucaucccgcccaacggguacuuccgguucgacuccugggugaaccagagcuacacccuggcccccaugggcaacggcgccgggcgccgccgggcccucuga

SEQ ID NO: 9275 - RNA, 1623 nt, Artificial Sequence
  derived and/or modified sequence opt1 from VP1__Norovirus__ABY27560
augaagauggccagcuccgacgccagccccuccgacggcagcaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcugcugggcaccacgcagcucagccccgucaacaucugcaccuuccggggcgacgugacccacaucgccgggacccacgacuacacgaugaaccuggccucccagaacuggaacaacuacgacccgaccgaggagauccccgcgccccugggcacccccgacuucguggggaagauccagggcguccucacccagacgacccgcggggacggcagcacccggggccacaaggccaccguguccacggggagcgugcacuucaccccgaagcugggcagcguccaguucaccaccgacacgaacaacgaccuggagaccgggcagaacaccaaguucacccccgugggcgugguccaggacgggaacuccgcccaccagaacgagccccagcagugggugcuccccaacuacagcggccgcacgggccacaacgugcaccuggccccggccgucgcccccaccuuccccggggagcagcuccucuucuuccgguccaccaugcccggcugcagcggguacccgaacaugaaccuggacugccugcucccccaggagugggugcugcacuucuaccaggaggcggcccccgcccaguccgacguggcccugcuccgcuucgucaaccccgacaccggccgggugcuguucgagugcaagcugcacaagagcggguacgugaccgucgcgcacacgggcccgcacgaccucgugaucccgcccaacggcuacuuccgcuucgacuccugggugaaccaguucuacacccuggcccccauggggaacggcgccgggcggcgccgggcccuguga

SEQ ID NO: 9276 - RNA, 1620 nt, Artificial Sequence
  derived and/or modified sequence opt1 from VP1__Norovirus__ACT76139
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucaccgccggcaaggugaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccaggcccacgacagcacccugaagcucaucgccaugcuguacacgccccugcgggcgaacaacgccggcgacgacguguucaccguguccugccgcguccucacccggcccagcccggacuucgacuucaucuuccuggugccgcccaccguggagucccgcaccaagcccuucacgguccccauccugaccguggaggagaugagcaacucccgguuccccaucccccucgagaagcuguacaccggccccagcuccgccuucgugguccagccgcagaacgggcgcugcaccacggacggcgugcugcucgggaccacccagcugagcgccgucaacaucugcaacuuccggggcgacgugacccgcgugggcaucucccacgacuacacgaugaaccuggucagccagaacuggaacaacuacgaccccaccgaggagauccccgccccgcucgggacccccgacuucgugggcaagauccaggggcugcugacccagacgacccgggcggacggcagcacccgcgcccacaaggccaccguguccacggggagcguccacuucacccccaagcucggcuccgugcaguucaccaccgacacgaacaacgacuuccagaccggccagaacaccaaguucacccccgugggggucauccaggacggcgaccaccaccagaacgagccgcagcagugggugcugcccaacuacagcgggacguccggccacaacgugcaccuggcccccgccgucgcgcccaccuucccgggggagcagcuccuguucuuccggagcaccaugcccggcugcuccggcuaccccaacaugaaccuggacugccuccugccccaggagugggugcugcacuucuaccaggaggccgccccggcccagagcgacguggcgcuccugcgcuucgucaaccccgacaccgggcgggugcuguucgagugcaagcuccacaaguccggcuacaucacgguggcccacaccgggcccuacgaccuggucaucccgcccaacggcuacuuccgcuucgacagcugggugaaccaguucuacacccuggcccccauggggaacggcaccggccggcgccgggcccucuga

SEQ ID NO: 9277 - RNA, 1620 nt, Artificial Sequence
  derived and/or modified sequence opt1 from VP1__Norovirus__ACT76142
augaagauggccagcuccgacgccaaccccagcgacggcuccaccgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugagcccggaccucaaccccuaccugucccaccugagccgcauguacaacggcuacgccggcggguucgagguccaggugauccucgccggcaacgccuucacggccgggaagaucaucuucgcggccaucccgcccaacuucccgaccgagggccugucccccagccaggugaccauguucccccacaucaucguggacgugcggcagcuggagcccguccucaucccgcugcccgacgugcgcaacaacuucuaccacuacaaccaggcccacgacuccacccugaagcucaucgccaugcuguacacgccccugcgggccaacaacgcgggggacgacguguucaccgucagcugccgcgugcucacccggcccuccccggacuucgacuucaucuuccuggugccgcccaccgucgagagccgcacgaagcccuucaccgugcccauccugaccguggaggagauguccaacagccgguuccccaucccccucgagaagcuguacaccggccccuccagcgccuucgucgugcagccgcagaacggccgcugcacgaccgacggggugcugcucggcaccacccagcuguccgccgucaacaucugcaacuuccgcggggacgugacgcgggucggcaucagccacgacuacaccaugaaccuggugagccagaacuggaacaacuacgaccccaccgaggagauccccgccccgcucggcacccccgacuucguggggaagauccagggccugcugacgcagaccacccgggccgacggguccacccgcgcgcacaaggccacggucagcaccggcuccgugcacuucacccccaagcucgggagcgugcaguucaccacggacaccaacaacgacuuccagaccggccagaacaccaaguucacgcccgucggcgugauccaggacggggaccaccaccagaacgagccgcagcagugggugcugcccaacuacuccggcaccagcgggcacaacguccaccuggcccccgccguggcccccaccuucccgggcgagcagcuccuguucuuccgguccaccaugcccgggugcagcggcuaccccaacaugaaccuggacugccuccugccccaggagugggugucccacuucuaccaggaggcggccccggcccagagcgacgucgcccugcuccgcuucgugaaccccgacacgggccgggugcuguucgagugcaagcugcacaaguccggguacaucaccgucgcgcacaccggccccuacgaccucgugaucccgcccaacggguacuuccgcuucgacagcugggugaaccaguucuacacccuggcccccaugggcaacggguccggccggaagcgcguccuguga

SEQ ID NO: 9278 - RNA, 1620 nt, Artificial Sequence
  derived and/or modified sequence opt1 from VP1__Norovirus__ACT76145
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucaccgccggcaaggugaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagccacgacuccacccugaagcucaucgccaugcuguacacgccccugcgggccaacaacgcgggcgacgacguguucaccgugagcugccgcguccucacccggcccuccccggacuucgacuucaucuuccuggugccgcccaccguggagagccgcaccaagcccuucacgguccccauccugaccguggaggagauguccaacagccgguuccccaucccccucgagaagcuguacaccggccccuccagcgccuucgugguccagccgcagaacgggcgcugcaccacggacggcgugcugcucgggaccacccagcuguccgccgucaacaucugcaacuuccggggcgacgugacccacaucgugggcagccacgacuacacgaugaaccuggucagccagaacugguccaacuacgaccccaccgaggagauccccgccccgcucgggacccccgacuucgugggcaagauccaggggcugcugacccagacgacccgcgccgacggcagcacccgggcgcacaaggccaccguguccacggggagcguccacuucacccccaagcucggcuccgugcaguucaccaccgacacgaacaacgacuuccagaccggccagaacaccaaguucacccccgugggggucauccaggacggcgaccaccaccagaacgagccgcagcagugggugcugcccaacuacagcgggcgcacgggccacaacgugcaccuggcccccgccgucgcccccaccuucccgggggagcagcuccuguucuuccgguccaccaugcccggcugcagcggcuaccccaacaugaaccuggacugccuccugccccaggagugggugcugcacuucuaccaggaggcggccccggcccaguccgacguggcccuccugcgcuucgucaaccccgacaccgggcgggugcuguucgagugcaagcuccacaagagcggcuacaucacgguggcgcacaccgggcccuacgaccuggucaucccgcccaacggcuacuuccgcuucgacuccugggugaaccaguucuacacccuggcccccauggggaacggcaccggccggcgccgggcccucuga

SEQ ID NO: 9279 - RNA, 1620 nt, Artificial Sequence
  derived and/or modified sequence opt1 from VP1__Norovirus__ACT76148
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccugagccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucaucguggacgugcggcagcuggagcccguccucaucccgcugcccgacgugcgcaacaacuucuaccacuacaaccaggcccacgacuccacccugaagcucaucgccaugcuguacacgccccugcgggcgaacaacgccggcgacgacguguucaccgucagcugccgcgugcucacccggcccuccccggacuucgacuucaucuuccuggugccgcccaccgucgagagccgcaccaagcccuucacggugcccauccugaccguggaggagauguccaacagccgguuccccaucccccucgagaagcuguacaccggccccuccagcgccuucgucgugcagccgcagaacgggcgcugcaccacggacggcguccugcucgggaccacccagcuguccgccgugaacaucugcaacuuccggggcgacgugacccacaucgucggcagccacgacuacacgaugaaccuggugucccagaacuggagcaacuacgaccccaccgaggagauccccgccccgcucgggacccccgacuucgugggcaagauccaggggcugcugacccagacgacccgcgcggacggcagcacccgggcccacaaggccaccgucuccacggggagcgugcacuucauccccaagcucggcuccgugcaguucaccaccgacaccaacaacgacuuccagacgggccagaacaccaaguucacccccgucggggugauccaggacggcgaccaccaccagaacgagccgcagcagugggugcugcccaacuacagcgggcgcaccggccacaacguccaccuggcccccgccguggcgcccacguucccgggggagcagcuccuguucuuccgguccaccgugcccggcugcagcggcuaccccaacaugaaccuggacugccuccugccccaggagugggucucccacuucuaccaggaggccgccccggcccagagcgacguggcgcugcuccgcuucgugaaccccgacaccgggcggguccuguucgagugcaagcugcacaaguccggcuacaucaccguggcccacacggggcccuacgaccucgugcugcccccgaacggcuacuuccgcuucgacagcugggucaaccaguucuacacccuggcccccauggggaacggcaccggccggcgccgggcccucuga

SEQ ID NO: 9280 - RNA, 1620 nt, Artificial Sequence
  derived and/or modified sequence opt1 from VP1__Norovirus__ACT76151
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccugucccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucaucguggacgugcggcagcuggagcccguccucaucccgcugcccgacgugcgcaacaacuucuaccacuacaaccaggcccacgacagcacccugaagcucaucgccaugcuguacacgccccugcgggcgaacaacgccggcgacgacguguucaccgucuccugccgcgugcucacccggcccagcccggacuucgacuucaucuuccuggugccgcccaccgucgagucccgcaccaagcccuucacggugcccauccugaccguggaggagaugagcaacucccgguuccccaucccccucgagaagcuguacaccggccccagcuccgccuucgucgugcagccgcagaacgggcgcugcaccacggacggcguccugcucgggaccacccagcugagcgccgugaacaucugcaacuuccggggcgacgugacccgcgucggcaucucccacgacuacacgaugaaccuggugagccagaacuggaacaacuacgaccccaccgaggagauccccgccccgcucgggacccccgacuucgugggcaagauccaggggcugcugacccagacgacccgggcggacggcagcacccgcgcccacaaggccaccgucuccacggggagcgugcacuucacccccaagcucggcuccgugcaguucaccaccgacacgaacaacgacuuccagaccggccagaacaccaaguucacccccgucggggugauccaggacggcgaccaccaccagaacgagccgcagcagugggugcugcccaacuacagcgggacguccggccacaacguccaccuggcccccgccguggcgcccaccuucccgggggagcagcuccuguucuuccggagcaccaugcccggcugcuccggcuaccccaacaugaaccuggacugccuccugccccaggagugggugcugcacuucuaccaggaggccgccccggcccagagcgacgucgcgcuccugcgcuucgugaaccccgacaccgggcgggugcuguucgagugcaagcuccacaaguccggcuacaucacggucgcccacaccgggcccuacgaccuggugaucccgcccaacggcuacuuccgcuucgacagcugggugaaccaguucuacacccuggcccccauggggaacggcaccggccggcgccgggcccucuga

SEQ ID NO: 9281 - RNA, 1623 nt, Artificial Sequence
  derived and/or modified sequence opt1 from VP1__Norovirus__ACX31821
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggaacaacuacgaccccacggaggagaucccggcgccccuggggacccccgacuucgugggcaagauccaggggaugcucacccagaccacgcgcagcgacggcuccacccgggggcacaaggccaccgucuucaccggcagcgccgacuucgcccccaagcugggccgcgugcaguucgccacggacaccgacaacgacuucgagagcgggcagaacaccaaguucaccccggugggcgucauccaggacggguccacgacccaccggaacgagccccagcagugggugcugcccaacuacagcggccgcaccgggcacaacgugcaccucgcgcccgccgucgccccgaccuaccccggcgagcagcugcuguucuuccgguccacgaugcccggcugcagcggguaccccaacauggaccucgacugccugcugccgcaggagugggugcagcacuucuaccaggaggccgcgcccgcccaguccgacguggcccuccugcgcuucgucaaccccgacaccggccgggugcuguucgagugcaagcuccacaagagcggguacgugaccgucgcccacaccggccagcacgaccuggugaucccgcccaacggguacuuccgcuucgacuccugggugaaccaguucuacacccuggcccccaugggcaacggcacggggcgccggcgcgcgcucuga

SEQ ID NO: 9282 - RNA, 1623 nt, Artificial Sequence
  derived and/or modified sequence opt1 from VP1__Norovirus__ACX31837
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccagaacaccaaguucacgcccgucggggugauccaggacggcagcaccacccaccgcaacgagccccagcagugggugcuccccuccuacagcgggcggaacguccacaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 9283 - RNA, 1623 nt, Artificial Sequence
  derived and/or modified sequence opt1 from VP1__Norovirus__ACX31841
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcacccccuucacgccgaagcugggcagcgugcaguucuccaccgacaccgagaacgacuucgagacccaccagaacacgaaguucacccccgucggggugauccaggacggcagcaccacccaccgcaacgagccccagcagugggugcuccccuccuacagcgggcgggacguccacaacgugcaccuggccccggccguggcccccacguuccccggcgagcagcuccucuucuuccgcuccaccaugcccggcugcagcggguacccgaacauggaccuggacugccugcucccccaggaguggguccagcacuucuaccaggaggcggcccccgcccaguccgacguggcccugcugcgguucgugaaccccgacaccggccgcguccucuucgagugcaagcugcacaagagcggguacgugaccguggcgcacaccggccagcacgaccuggucaucccgcccaacggguacuuccgguucgacuccugggugaaccaguucuacacgcucgcccccaugggcaacggcaccgggcgccggcgcgcccuguga

SEQ ID NO: 9284 - RNA, 1623 nt, Artificial Sequence
  derived and/or modified sequence opt1 from VP1__Norovirus__ACX31851
augaagauggccagcaacgacgccaaccccuccaacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9285 - RNA, 1623 nt, Artificial Sequence
  derived and/or modified sequence opt1 from VP1__Norovirus__ACX31856
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgaggcccaccagaacaccaaguucacccccgucggcgugauccaggacgggggcacgacccaccgcaacgagccccagcagugggugcuccccagcuacuccgggcggaacgucccgaacgugcaccuggcccccgcgguggcccccaccuuccccggcgagcagcuccucuucuuccgcagcaccaugccgggcugcuccggguaccccaacauggaccuggacugccugcucccccaggaguggguccagcacuucuaccaggaggccgcccccgcgcagagcgacguggcccugcugcgguucgugaacccggacacgggccgcguccucuucgagugcaagcugcacaaguccggguacgugaccguggcccacaccggccagcacgaccuggucauccccagcaacggguacuuccgguucgacuccugggugaaccaguucuacacccucgcccccaugggcaacggcaccgggcgccggcgcgugcuguga

SEQ ID NO: 9286 - RNA, 1623 nt, Artificial Sequence
  derived and/or modified sequence opt1 from VP1__Norovirus__ACX31860
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcgacuacaccaugaaccuggccucccugaacuggaacaacuacgaccccaccgaggagaucccggcgccccucggcacgcccgacuucguggggaagauccagggcguccugacccagaccaccgagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9287 - RNA, 1623 nt, Artificial Sequence
  derived and/or modified sequence opt1 from VP1__Norovirus__ACX31864
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggacaugaaccccuaccucagccaccuggcccgcauguacaacggcuacgccgggggcuucgaggugcaggucauccuggccgggaacgccuucacggcgggcaagaucaucuucgccgccgugccgcccaacuucccgaccgaggggcucucccccagccaggugaccauguucccccacaucaucgucgacgugcggcagcuggagcccgugcugaucccgcuccccgacguccgcaacaacuucuaccacuacaaccaguccaacgaccccaccaucaagcugaucgccaugcuguacacgccccuccgggccaacaacgcgggcgacgacguguucaccgugagcugccgcguccugacccggccgucccccgacuucgacuucaucuuccuggugccgcccaccguggagagccgcacgaagcccuucuccguccccauccucaccguggaggagaugaccaacagccgguuccccaucccccuggagaagcuguucaccggcccguccagcgccuucgugguccagccccagaacgggcgcugcacgaccgacggcgugcuccuggggaccacccagcugucccccgucaacaucugcacguuccggggcgacgugacccacaucgccggcagccgcaacuacaccaugaaccucgccucccagaacuggaacagcuacgacccgaccgaggagauccccgcgccccuggggacgcccgacuucgugggcaagauccaggggguccugacccagaccacccggacggacggcagcacccgcgggcacaaggccaccguguacaccggcuccgccgacuucagcccgaagcucggccgggugcaguucgccacggacaccgacaacgacuucgucgccaaccagaacaccaaguucacccccgugggggugauccaggacggcaacacggcccaccgcaacgagccccagcaguggguccugcccuccuacagcgggcggaacacccacaacgugcaccuggcgccggccguggcccccaccuuccccggcgagcagcuccuguucuuccgcuccaccaugcccgggugcagcggcuacccgaacauggaccuggacugccuccugccccaggaguggguccaguacuucuaccaggaggccgcgcccgcccaguccgacguggcccugcuccgguucgugaaccccgacacgggccgcguccuguucgagugcaagcugcacaagagcggguacgugaccguggcccacaccggccagcacgaccucgucaucccgcccaacggguacuuccgguucgacuccugggugaaccaguucuacacccuggcccccaugggcaacgggaccggccgccgccgggcgcuguga

SEQ ID NO: 9288 - RNA, 1623 nt, Artificial Sequence
  derived and/or modified sequence opt1 from VP1__Norovirus__ACX31889
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggacaugaaccccuaccucagccaccuggcccgcauguacaacggcuacgccgggggcuucgaggugcaggucauccuggccgggaacgccuucacggcgggcaagaucaucuucgccgccgugccgcccaacuucccgaccgaggggcucucccccagccaggugaccauguucccccacaucaucgucgacgugcggcagcuggagcccgugcugaucccgcuccccgacguccgcaacaacuucuaccacuacaaccaguccaacgaccccaccaucaagcugaucgccaugcuguacacgccccuccgggccaacaacgcgggcgacgacguguucaccgugagcugccgcguccugacccggccgucccccgacuucgacuucaucuuccuggugccgcccaccguggagagccgcacgaagcccuucuccguccccauccucaccguggaggagaugaccaacagccgguuccccaucccccuggagaagcuguucaccggcccguccagcgccuucgugguccagccccagaacgggcgcugcacgaccgacggcgugcuccuggggaccacccagcugucccccgucaacaucugcacguuccggggcgacgugacccacaucgccggcagccgcaacuacaccaugaaccucgccucccagaacuggaacagcuacgacccgaccgaggagauccccgcgccccuggggacgcccgacuucgugggcaagauccaggggguccugacccagaccacccggacggacggcagcacccgcgggcacaaggccaccguguacaccggcuccgccgacuucagcccgaagcucggccgggugcaguucgccacggacaccgacaacgacuucgacgccaaccagaacaccaaguucacccccgucggggugauccaggacggcaacacggcccaccgcaacgagccccagcagugggugcugcccuccuacagcgggcggaacacccacaacguccaccuggcgccggccguggcccccaccuuccccggcgagcagcuccuguucuuccgcuccaccaugcccgggugcagcggcuacccgaacauggaccuggacugccuccugccccaggagugggugcaguacuucuaccaggaggccgcgcccgcccaguccgacgucgcccugcuccgguucgugaaccccgacacgggccgcgugcuguucgagugcaagcugcacaagagcggguacgucaccguggcccacaccggccagcacgaccucgugaucccgcccaacggguacuuccgguucgacuccugggucaaccaguucuacacccuggcccccaugggcaacgggaccggccgccgccgggcgcuguga

SEQ ID NO: 9289 - RNA, 1608 nt, Artificial Sequence
  derived and/or modified sequence opt1 from VP1__Norovirus__ACX31893
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggaggugcuccugaaccuggagcucggccccgagcugaacccguaccuggcccaccucucccgcauguacaacggcuacgccgggggcgucgagguccaggugcugcuggccgggaacgccuucaccgccggcaagcucguguucgcggccgugccgccccacuucccccuggagaacaucagccccgggcagaucaccauguucccccacgugaucaucgacguccggacccuggagcccgugcuccugccccugccggacgugcgcaacaacuucuuccacuacaaccagcagaacgagcagcggaugcgccucgucgccaugcuguacacgccccugcgguccaacggcagcggcgacgacguguucaccguguccugccgcguccucacccggcccagccccgacuucgacuucaacuaccuggugccgcccaccguggaguccaagacgaagcccuucacccugcccauccucaccaucggggagcugaccaacagccgcuucccgguccccaucgacgagcuguacacgucccccaacgagagccucguggugcagccccagaacggccggugcgcccuggacggggagcugcagggcaccacccagcuccugccgaccgccaucugcuccuuccgcggccggaucaaccagaaggucagcggggagaaccacguguggaacaugcaggucacgaacaucaacggcacccccuucgaccccaccgaggacgugccggcgccccuggggacccccgacuucuccggcaagcuguucggggugcucagccagcgcgaccacgacaacgccugccggucccacgacgccgucaucgccacgaacagcgccaaguucacccccaagcugggcgcgauccagaucggcaccugggagcaggacgacgugcacaucaaccagccgaccaaguucacgcccgugggccucuucgagagcgagggguucaaccaguggacccugcccaacuacuccggggcccugacccucaacaugggccuggcgcccccggucgcccccaccuuccccggggagcagauccuguucuuccgcagccacaucccccucaagggcggcguggccgacccggugaucgacugccugcugccccaggaguggauccagcaccucuaccaggaguccgcccccagccagacggacgucgcccugauccgguucaccaaccccgacaccgggcgcgugcuguucgaggccaagcuccaccgguccggcuacaucaccguggccaacacggggagccgcccgaucgucgugcccgcgaacggcuacuuccgguucgacuccugggugaaccaguucuacagccuggcccccauggggaccggcaacggccgccgccggguccaguga

SEQ ID NO: 9290 - RNA, 1749 nt, Artificial Sequence
  derived and/or modified sequence opt1 from VP1__Norovirus__ACX69259
augaagauggccagcaacgacgccgcgcccccguccagcgacggcgccgccaaccuggugcccgagaucaacaacgaggucauggcccucgagcccguggccggggcgcagcuggccgcccccguggccggccaguucaacgcgaucgacccguggauccgccagaacuucguccaggcccccgagggggaguucaccgugagcccccggaacgcccccggcgagauccugcucaaccuggagcuggggccgcaccucaaccccuuccugcagcaccuggcccagauguacaacgccuacgcgggcggcauggaggugcaggucgugcucgccgggaacgccuucaccgccggcaagaucaucuucgccgcgaucccgccccacuucccgcccgagcgccuguccgccgcccaggccacgcaguucccccacgugaucgucgacgugcggcagcuggagcccaucgugcucccccugcccgacguccgccacaaccuguuccacuucaaccagcagaacgacgagcggaugcaccucguggccuuccuguacacgccccugcgcgcgaacuccgggaacggcgacgacguguucaccgucagcugccgggugcucacccgccccucccaggacuucgaguucauguuccuggugccgcccaccgucgagaagaagaccguggccuucagccugccccagcucgccgugggggagauguccaacagccgguggcccgcccgcaucaccggcauggucguggacccgcggcugccccaggugcugcacauccagaacggccgcugcacccucgacgggacgcugaugggcaccacccagcugaaccccaacgacaucugccggauccgcggguacuucuccagcucccggcccgagcuccugugcgagggcgaggagagcgaggucaacaccacgccgaccgacuccggcgccaccggggaccagacccccgaggugcgcacgggcacccgggcgacccagcgcugguucgccgucaccgagcugaacggccagguguacgaccccuucggggaccagccggcgccccucggggugcccgacuucaaggcccggauccugggcgcccugaugcgccuccccggcacgaacccgaccagcaacucccgguucgaggacgccugggucgagaccaacaaccagaccacguacgcccccgccaccggggugguggccaucaccaccaacgacaacagcuccggcaacuacgcgaacgaccagacgugcgaguucgucccccuggggaucgagaucaccgacagcgcccccuacaacgaguucgaccugccgagcuacggcggggccgccuccagcggcaaccgcaaccucgcccccaccguggcgcccaccuuccccggcgaggccauccugcuguucggguccaacaugccgguguacaaccgcagcuccggcacggacaacaaggacauccggugccuccugcccaacgaguacguccagcaccuguacgacacccaggcccccagccucuccgacguggcccuggugcgcuacgucaaccgggacaccgggcgcgugcuguucgaggccaagcuccaccgggacggcuucaugaccgugaacgcgagcuccacgaccguccugcccguggacggguacuuccgcuucgacagcugggugaaccaguucuacgcccuguccccggucggcaacgccagcggccggcgcgggcggucccgccaggccaacuga

SEQ ID NO: 9291 - RNA, 1647 nt, Artificial Sequence
  derived and/or modified sequence opt1 from VP1__Norovirus__ADF47131
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcuggucgccaugcuguacaccccgcuccgcgccaacaacuccggcgacgacguguucaccgugagcugccggguccugacgcgccccucccccgacuucagcuucaacuuccuggugcccccgaccguggaguccaagaccaagcccuucacccuccccauccugacgaucagcgagauguccaacagccgguuccccgucccgaucgacucccugcacaccagccccaccgagaacaucguggugcagugccagaacgggcgcgucacccucgacggcgagcugauggggacgacccagcugcuccccucccagaucugcgccuuccggggcgugcugacccgcagcaccucccgggcgagcgaccaggccgacacggccacgccccgccuguucaacuacuacuggcacauccagcucgacaaccugaacggcaccccguacgaccccgccgaggacauccccgggccgcugggcacccccgacuuccgggggaagguguucggcgucgccagccagcgcaaccccgacuccaccacccgggcgcacgaggccaagguggacaccaccgccgggcgcuucacgcccaagcucggcagccuggagaucuccaccgagagcggcgacuucaaccagaaccagccgacccgguucacccccgucgggaucggcguggaccacgaggaggacuuccagcaguggucccugcccgacuacagcgggcaguucacgcacaacaugaaccucgcccccgcgguggccccgaacuuccccggcgagcagcugcuguucuuccgcucccagcuccccagcuccgggggccggagcaacggcauccuggacugccuggucccccaggagugggugcagcacuucuaccaggaguccgccccgacccagacccagguggcccucguccgcuacgugaaccccgacaccgggcgcgugcuguucgaggccaagcugcacaagcucggcuucaugacgaucgcgaagaacggggacagccccaucaccgugcccccgaacggcuacuuccgguucgaguccugggugaaccccuucuacacccuggcccccaccgggacggagaacggccgccggcgcgugcaguga

SEQ ID NO: 9292 - RNA, 1623 nt, Artificial Sequence
  derived and/or modified sequence opt1 from VP1__Norovirus__ADR78869
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9293 - RNA, 1623 nt, Artificial Sequence
  derived and/or modified sequence opt1 from VP1__Norovirus__ADR78872
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucagcgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccagaacaccaaguucacgcccgucggggugacccaggacggcagcaccacccaccgcaacgagccccagcagugggugcuccccuccuacagcgggcggaacguccacaacgugcaccuggccccggccguggcccccacguuccccggcgagcagcuccucuucuuccgcuccaccaugcccggcugcagcggguacccgaacauggaccuggacugccugcucccccaggaguggguccagcacuucuaccaggaggcggcccccgcccaguccgacguggcccugcugcgguucgugaaccccgacaccggccgcguccucuucgagugcaagcugcacaagagcggguacgugaccguggcgcacaccggccagcacgaccuggucaucccgcccaacggguacuuccgguucgacuccugggugaaccaguucuacacgcucgcccccaugggcaacggcaccgggcgccggcgcgcccuguga

SEQ ID NO: 9294 - RNA, 1623 nt, Artificial Sequence; identical to SEQ ID NO: 9292
  derived and/or modified sequence opt1 from VP1__Norovirus__ADR78875

SEQ ID NO: 9295 - RNA, 1623 nt, Artificial Sequence; identical to SEQ ID NO: 9292
  derived and/or modified sequence opt1 from VP1__Norovirus__ADR78878

SEQ ID NO: 9296 - RNA, 1623 nt, Artificial Sequence; identical to SEQ ID NO: 9292
  derived and/or modified sequence opt1 from VP1__Norovirus__ADR78881

SEQ ID NO: 9297 - RNA, 1623 nt, Artificial Sequence; identical to SEQ ID NO: 9292
  derived and/or modified sequence opt1 from VP1__Norovirus__ADR78884

SEQ ID NO: 9298 - RNA, 1623 nt, Artificial Sequence
  derived and/or modified sequence opt1 from VP1__Norovirus__ADR78887
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugucccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccagaacaccaaguucacgcccgucggggugauccaggacggcagcaccacccaccgcaacgagccccagcagugggugcuccccuccuacagcgggcggaacguccacaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 9299 - RNA, 1623 nt, Artificial Sequence; identical to SEQ ID NO: 9292
  derived and/or modified sequence opt1 from VP1__Norovirus__ADR78890

SEQ ID NO: 9300 - RNA, 1623 nt, Artificial Sequence; identical to SEQ ID NO: 9292
  derived and/or modified sequence opt1 from VP1__Norovirus__ADR78893

SEQ ID NO: 9301 - RNA, 1623 nt, Artificial Sequence; identical to SEQ ID NO: 9292
  derived and/or modified sequence opt1 from VP1__Norovirus__ADR78896

SEQ ID NO: 9302 - RNA, 1623 nt, Artificial Sequence
  derived and/or modified sequence opt1 from VP1__Norovirus__ADR78899
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcgcccccgacuucguggggaagauccagggcguccugacgcagaccaccaagggggacggcagcacccggggccacaaggccacgguguacaccggguccgcccccuucaccccgaagcugggcagcgugcaguucagcaccgacacggagaacgacuucgagacccaccagaacaccaaguucacccccgucggggugauccaggacggcuccacgacccaccgcaacgagccccagcagugggugcuccccagcuacuccgggcggaacguccacaacgugcaccuggccccggcgguggcccccaccuuccccggcgagcagcuccucuucuuccgcagcaccaugcccggcugcuccggguacccgaacauggaccuggacugccugcucccccaggaguggguccagcacuucuaccaggaggccgcccccgcgcagagcgacguggcccugcugcgguucgugaaccccgacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggcgccggcgcgcccuguga

SEQ ID NO: 9303 - RNA, 1623 nt, Artificial Sequence; identical to SEQ ID NO: 9292
  derived and/or modified sequence opt1 from VP1__Norovirus__ADR78902

SEQ ID NO: 9304 - RNA, 1623 nt, Artificial Sequence; identical to SEQ ID NO: 9292
  derived and/or modified sequence opt1 from VP1__Norovirus__ADR78905

SEQ ID NO: 9305 - RNA, 1623 nt, Artificial Sequence
  derived and/or modified sequence opt1 from VP1__Norovirus__ADR78908
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacguccacaacgugcaccuggccccggccguggcgcccaccuuccccggggagcagcuccucuucuuccgcuccacgaugcccggcugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcgcccuguga

SEQ ID NO: 9306 - RNA, 1623 nt, Artificial Sequence
  derived and/or modified sequence opt1 from VP1__Norovirus__ADR78911
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcugcuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccagcuguccaccgacaccagcaacgacuucgagacggggcagaacacccgguucacccccgugggcgugguccaggacggguccaccacgcaccagaacgagccccagcagugggugcuccccgacuacagcggccgcgacucccacaacgugcaccuggccccggccgucgcccccaccuuccccggggagcagcuccucuucuuccggagcaccaugcccggcugcuccggcuacccgaacaugaaccuggacugccugcucccccaggagugggugcagcacuucuaccaggagagcgcccccgcgcaguccgacguggcccugcugcgcuucgucaaccccgacaccgggcggguccucuucgagugcaagcugcacaagagcggcuacgugaccguggcccacacggggcagcacgaccuggugaucccgcccaacggcuacuuccgcuucgacuccugggugaaccaguucuacacccucgcccccauggggaacggcgcgggccggcgccgcgcccuguga

SEQ ID NO: 9307 - RNA, 1623 nt, Artificial Sequence
  derived and/or modified sequence opt1 from VP1__Norovirus__ADR78914
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccaguucuccaccgacaccagcaacgacuucgagacggggcagaacacccgguucacccccgugggcgugguccaggacggguccaccacgcaccagaacgagccccagcagugggugcugcccgacuacagcggccgcgacucccacaacgugcaccucgccccggccgucgcccccaccuuccccggggagcagcugcuguucuuccggagcaccaugcccggcugcuccggcuacccgaacaugaaccucgacugccugcugccccaggagugggugcagcacuucuaccaggagagcgcccccgcgcaguccgacguggcccuccugcgcuucgucaaccccgacaccgggcgggugcuguucgagugcaagcuccacaagagcggcuacgugaccgucgcccacacggggcagcacgaccuggugaucccgcccaacggcuacuuccgcuucgacuccugggugaaccaguucuacacccuggcccccauggggaacggcgcgggccggcgccgcgcccucuga

SEQ ID NO: 9308 - RNA, 1623 nt, Artificial Sequence
  derived and/or modified sequence opt1 from VP1__Norovirus__ADR78917
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggccgcauccaggggguccucacccagacgacccggcgcgacggcagcacccgggggcacaaggccaccguguccacgggcagcgugcacuucaccccgaagcugggcagcguccaguucuccaccgacaccagcaacgacuucgagacggggcagaacacccgcuucacccccgugggcgugguccaggacggguccaccacgcaccagaacgagccccagcagugggugcugcccgacuacagcggccgggacucccacaacgugcaccucgccccggccgucgcccccaccuuccccggggagcagcugcuguucuuccgcagcaccaugcccggcugcuccggcuacccgaacaugaaccucgacugccugcugccccaggagugggugcagcacuucuaccaggagagcgcccccgcgcaguccgacguggcccuccugcgguucgucaaccccgacaccgggcgcgugcuguucgagugcaagcuccacaagagcggcuacgugaccgucgcccacacggggcagcacgaccuggugaucccgcccaacggcuacuuccgguucgacuccugggugaaccaguucuacacccuggcccccauggggaacggcgcgggccgccgccgggcccucuga

SEQ ID NO: 9309 - RNA, 1623 nt, Artificial Sequence
  derived and/or modified sequence opt1 from VP1__Norovirus__ADR78920
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccaguucuccaccgacaccagcaacgacuucgagacggggcagaacacccgguucacccccgugggcgugguccaggacggggacaccacgcaccagaacgagccccagcagugggugcugcccgacuacuccggccgcgacagccacaacgugcaccucgccccggccgucgcccccaccuuccccggggagcagcugcuguucuuccgguccaccaugcccggcugcagcggcuacccgaacaugaaccucgacugccugcugccccaggagugggugcagcacuucuaccaggaguccgcccccgcgcagagcgacguggcccuccugcgcuucgucaaccccgacaccgggcgggugcuguucgagugcaagcuccacaaguccggcuacgugaccgucgcccacacggggcagcacgaccuggugaucccgcccaacggcuacuuccgcuucgacagcugggugaaccaguucuacacccuggcccccauggggaacggcgcgggccggcgccgcgcccucuga

SEQ ID NO: 9310 - RNA, 1623 nt, Artificial Sequence
  derived and/or modified sequence opt1 from VP1__Norovirus__ADR78923
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcaccaagcccuucuccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucgccggcacccagaacuacacgaugaaccuggccagccagaacuggaacaacuacgaccccaccgaggagaucccggcgccccuggggacccccgacuucgugggcaagauccaggggguccucacccagacgacccgccgggacggcuccacccgcgggcacaaggccaccgugagcacgggcagcgugcacuucacccccaagcugggcuccguccaguucagcaccgacaccuccaacgacuucgagacggggcagaacacccgguucaccccggugggcgugguccaggacgggagcaccacgcaccagaacgagccccagcagugggugcugcccgacuacuccggccgcgacagccacaacgugcaccucgcccccgccgucgccccgaccuuccccggggagcagcugcuguucuuccgguccaccaugcccggcugcagcggcuaccccaacaugaaccucgacugccugcugccgcaggagugggugcagcacuucuaccaggaguccgcccccgcgcagagcgacguggcccuccugcgcuucgucaaccccgacaccgggcgggugcuguucgagugcaagcuccacaaguccggcuacgugaccgucgcccacacggggcagcacgaccuggugaucccgcccaacggcuacuuccgcuucgacagcugggugaaccaguucuacacccuggcccccauggggaacggcgcgggccggcgccgcgcccucuga

SEQ ID NO: 9311 - RNA, 1623 nt, Artificial Sequence
  derived and/or modified sequence opt1 from VP1__Norovirus__ADR78929
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucagcggcacccgcacguaccggaugaaccuggccucccagaacuggaacaacuacgaccccaccgaggagaucccggcgccccuggggacccccgacuucgugggcaagauccaggggaugcucacccagacgaccaagggcgacgggagcacccgcggccacaaggccaccgucagcacgggcuccguggacuucacccccaagcuggggagcgugcaguucgccaccgacaccgacaacgacuucgagacgggccagaacacccgguucaccccggucggggugauccaggacggcuccagcgcccaccgcaacgagccccagcagugggugcugcccgacuacuccgggcggaccguccacaacgugcaccucgcccccgccguggccccgacguuccccggcgagcagcugcuguucuuccgcagcaccaugcccggcugcuccggguaccccaacauggaccucgacugccugcugccgcaggaguggguccagcacuucuaccaggaggcggcccccagccaguccgacguggcccuccugcgguucgugaaccccgacaccggccgcguccuguucgagugcaagcuccacaaggccggguacgugaccguggcgcacaccggccagcacgaccuggucaucccgcccaacggguacuuccgguucgacagcugggugaaccaguucuacacgcuggcccccaugggcaacggcgccgggcgccgccgggcccucuga

SEQ ID NO: 9312 - RNA, 1623 nt, Artificial Sequence
  derived and/or modified sequence opt1 from VP1__Norovirus__ADR78932
augaagauggccagcuccgacgccagccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucuccggcagccgcaacuaccggaugaaccuggccagccagaacuggaacaacuacgaccccaccgaggagaucccggcgccccuggggacccccgacuucgugggcaagauccaggggaugcucacgcagaccaccaagggcgacggguccacccgcggccacaaggccacggucagcaccggcuccguggacuucacccccaagcuggggagcgugcaguucgccaccgacacggacaacgacuucgagaccggccagaacacccgguucaccccggucggggugauccaggacggcuccagcgcccaccgcaacgagccccagcagugggugcugcccgacuacuccgggcggacgguccacaacgugcaccucgcccccgccguggcgccgaccuuccccggcgagcagcugcuguucuuccgcagcaccaugcccggcugcuccggguaccccaacauggaccucgacugccugcugccgcaggaguggguccagcacuucuaccaggaggccgcccccagccaguccgacguggcccuccugcgguucgugaaccccgacaccggccgcguccuguucgagugcaagcuccacaaggcgggguacgugacgguggcccacaccggccagcacgaccuggucaucccgcccaacggguacuuccgguucgacagcugggugaaccaguucuacacccuggcccccaugggcaacggcgccgggcgccgccgggcccucuga

SEQ ID NO: 9313 - RNA, 1623 nt, Artificial Sequence
  derived and/or modified sequence opt1 from VP1__Norovirus__ADR78938
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcagcuaccggaugaaccuggccucccagaacuggaacaacuacgacccgacggaggagauccccgcgccccuggggacccccgacuucgugggcaagauccaggggaugcucacccagaccacgaagcgcgacggcagcacccgggggcacaaggccaccgucagcaccggcuccguggacuucacgccgaagcugggcagcgugcaguucgccaccgacaccgacaacgacuucgagaccgggcagaacacgcgcuucacccccgucggcgugauccaggacggguccagcacccaccggaacgagccccagcagugggugcugcccgacuacuccggccgcaccguccacaacgugcaccucgccccggccguggcccccacguuccccggggagcagcugcuguucuuccggagcaccaugcccggcugcuccggcuacccgaacauggaccucgacugccugcugccccaggaguggguccagcacuucuaccaggaggccgcgcccagccaguccgacguggcccuccugcgcuucgugaaccccgacaccgggcggguccuguucgagugcaagcuccacaaggccggcuacgugaccguggcccacaccgggcagcacgaccuggucaucccgcccaacggcuacuuccgcuucgacagcugggugaaccaguucuacacgcuggcgcccauggggaacggcgccggccgccggcgcgcccucuga

SEQ ID NO: 9314 - RNA, 1623 nt, Artificial Sequence; identical to SEQ ID NO: 9155
  derived and/or modified sequence opt1 from VP1__Norovirus__ADR78941

SEQ ID NO: 9315 - RNA, 1623 nt, Artificial Sequence
  derived and/or modified sequence opt1 from VP1__Norovirus__ADR78944
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucagcggcucccgcaccuaccggaugaaccuggccagccagaacuggaacaacuacgaccccacggaggagaucccggcgccccuggggacccccgacuucgugggcaagauccaggggaugcucacccagaccacgaagggcgacgggagcacccgcggccacaaggccaccgucuccaccggcagcguggacuucacgcccaagcugggguccgugcaguucgccaccgacaccgacaacgacuucgagaccggccagaacacgcgguucaccccggucggggugauccaggacggcagcuccacccaccgcaacgagccccagcagugggugcugcccgacuacagcgggcggaccguccacaacgugcaccucgcccccgccguggccccgacguuccccggcgagcagcugcuguucuuccgcuccaccaugcccggcugcagcggguaccccaacauggaccucgacugccugcugccgcaggaguggguccagcacuucuaccaggaggccgcgcccucccagagcgacguggcccuccugcgguucgugaaccccgacaccggccgcguccuguucgagugcaagcuccacaaggccggguacgugaccguggcccacaccggccagcacgaccuggucaucccgcccaacggguacuuccgguucgacuccugggugaaccaguucuacacgcuggcgcccaugggcaacggcgccgggcgccgccgggcccucuga

SEQ ID NO: 9316 - RNA, 1623 nt, Artificial Sequence; identical to SEQ ID NO: 9155
  derived and/or modified sequence opt1 from VP1__Norovirus__ADR78947

SEQ ID NO: 9317 - RNA, 1623 nt, Artificial Sequence
  derived and/or modified sequence opt1 from VP1__Norovirus__ADR78950
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcagguccuccuggccgggaacgccuucaccgccggcaagaucaucuucgccgccgugccgcccacguucccgaccgaggggcugucccccagccaggugaccauguucccccacaucaucgucgacgugcggcagcucgagcccgugcugaucccgcugcccgacguccgcaacaacuucuaccacuacaaccaguccaacgacagcaccaucaagcucguggccaugcuguacacgccccugcgggcgaacaacgccggcgacgacguguucaccgucuccugccgcgugcucacccggcccagcccggacuucgacuucaucuuccuggugccgcccaccgucgagucccgcacgaagcccuucaccgugcccauccugaccguggaggagaugaccaacagccgguuccccaucccccucgagcgccuguucacgggccccuccagcgccuucgucgugcagccgcagaacgggcggugcaccaccgacggcguccugcucgggaccacgcagcugucccccgugaacaucugcaccuuccgcggcgacgugaccaacauccccggcagccggaccuaccgcaugaaccuggccucccagaacuggaacaacuacgacccgacggaggagauccccgcgccccucgggacccccgacuucgucggcaagauccagggggugcugacccagaccacgaagggcgacgggagcacccggggccacaaggccaccgugcgcaccggcagcgccgacuucacgccgaagcugggguccguccaguucgccaccgacaccgacaacgacuucgugaccggccagaacacgcgguucacccccgugggggucauccacgacggcagcuccgcccaccgcaacgagccccagcagugggugcuccccgaguacagcgggcgguccgugcacaacguccaccuggccccggcgguggcccccaccuuccccggcgagcagcuccucuucuuccgcagcaccaugcccggcugcuccggguacccgaacauggaccuggacugccugcucccccaggagugggugcagcacuucuaccaggaggccgcccccagccaguccgacgucgcgcugcugcgguucgugaaccccgacacgggccgcgugcuguucgagugcaagcugcacaaggccggguacgucaccguggcccacaccggccagcacgaccuggugaucccgcccaacggguacuuccgcuucgacagcugggucaaccaguucuacacccucgcccccaugggcaacggcgccgggcggcgccgggcgcuguga

SEQ ID NO: 9318 - RNA, 1623 nt, Artificial Sequence
  derived and/or modified sequence opt1 from VP1__Norovirus__ADR78956
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgucagcacgggcagcguggacuucaccccgaagcugggguccgugcaguucgccaccgacaccgacaacgacuucgagacgggccagaacacccgguucacccccgucggggugauccaggacggcagcuccgcccaccgcaacgagccccagcagugggugcugcccgacuacagcgggcggaccguccacaacgugcaccucgccccggccguggcccccacguuccccggcgagcagcugcuguucuuccgcuccaccaugcccggcugcagcggguacccgaacauggaccucgacugccugcugccccaggaguggguccagcacuucuaccaggaggcggcccccgcccaguccgacguggcccuccugcgguucgugaaccccgacaccggccgcguccuguucgagugcaagcuccacaagaccggguacgugaccguggcgcacacgggccagcacgaccuggucaucccgcccaacggguacuuccgguucgacagcugggugaaccaguucuacacccuggcccccaugggcaacggcgccgggcgccgccgggcccucuga

SEQ ID NO: 9319 - RNA, 1653 nt, Artificial Sequence
  derived and/or modified sequence opt1 from VP1__Norovirus__AEA02124
augaugauggccagcaaggacgccaccuccaacauggacggcaccagcggggcgggccagcuggugcccgagaacaacaacacguccgagccgaucaacauggagcccgucgccggggccgugaccgccgccgcgaccgccggccaggugaacaugaucgaccccuggaucaugaacaacuacguccaggcgccccagggggaguucaccaucagcccgaacaacacgcccggcgacauccucuucgaccugcagcugggcccccaccucaaccccuuccuggcccaccugucccagauguacaacgggugggugggcaacaugaaggugcgcgucgugcucgccgggaacgccuucagcgccggcaagaucaucgugugcugcaucccgcccggguucuccgcccccaacaucagcaucgcccaggcgaccauguucccccacgucaucgccgacgugcgggugcuggagccgaucgacaucccccuggacgacguccgcaacguccucuuccacaccaacgacaacggcaaccagaccaugcggcugcugugcaugcucuacacgccccugcgcuccggcgggaccagcuccggcaccgaccccuucgugaucgccgggcggguccugaccugcccgacgcccgacuucaacuuccucuuccuggugccgcccaccguggagcagaagaccaagcaguucagcguccccaaccugccccucaacgugauguccaacagccgcgugcccucccugcugaacgccauggucgugagccccgaccaggcccaggugguccaguuccagaacggccggugcacccucgacggccagaugcuggggacgaccaccguguccgcgagcugcgucgcccgcuuccggggcaagaccuuccaggccccggacaaccgccuggggaucaaccucgccgagaucuccggcgagcccuaccacgccuucgagagccccgcgccccugggguucccggacuucggcgacggcgacuggcacgugacggccaccaaggugacccccagccagcuggaggccaacgaccccgucgugguggggaacguccagccguacaacccccaguucgcgccccaccucggcacccuggugguggagaaccccacgccggaccaggucgccaccgggaccgaccuccuguucaacaucaccuggcuguccaaccgggccaacaaccgcuucaaccccugggugauccccaacuacggcagcacgcugaccgaggccgcccagcucgcccccuccaucuucccgcccggguucggcgagaccaucguguacuucaacagcaccuuccccgcggucggcgccacgacccacgccgccauccccugccugcugccgcaggaguucguggcccacuucgugaacgagcaggcgcccauccgcggggaggccgcccuccugcacuacaucgaccccgacacccaccggaaccugggcgaguucaagaucuaccccgagggguucgugaccugcgugccgaacgugggcgggacgggcccccagucccuccccaccaacggcgucuucguguucgugagcugggucucccgguacuaccagcugaagcccguggggaccgccggccaggcccgccggcugggguuccgccggguguga

SEQ ID NO: 9320 - RNA, 1647 nt, Artificial Sequence
  derived and/or modified sequence opt1 from VP1__Norovirus__AED02033
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucacccuccccauccugacgaucagcgagauguccaacagccgguuccccgugccgaucgacucccugcacaccagccccaccgagaacaucgucgugcagugccagaacgggcgcgugacccucgacggcgagcugauggggacgacccagcugcuccccucccagaucugcgccuuccggggcacccugauccgcagcaccucccgggcgagcgaccaggccgacacgagcacgccccgccuguucaacuacuacuggcacauccagcucgacaaccugaacggcaccccguacgaccccgccgaggacauccccgccccgcuggggacccccgacuuccggggcaaggucuucgggguggccucccagcgcaaccccgacagcaccacccgggcgcacgaggccaagguggacaccaccuccggccgcuucacgcccaagcucgggagccuggagaucaucaccgaguccgacgacuucgaccugaaccagagcaccaaguucaccccggucggcaucggcguggacaacgaggccgaguuccagcaguggucccuccccaacuacagcgggcaguucacgcacaacaugaaccuggcccccgcggucgcccccaacuucccgggcgagcagcuccuguucuuccggucccagcugcccagcuccgggggccgcagcaacggggugcuggacugccucgugccccaggaguggguccagcacuucuaccaggaguccgcccccgcccagacccagguggcccuggugcgguacgucaacccggacaccggccgcgugcuguucgaggcgaagcuccacaagcugggcuucaugaccaucgccaagaacggggacagccccaucacggugccgcccaacggcuacuuccgcuucgaguccugggucaaccccuucuacacccuggcccccauggggaccggcaacgggcggcgccggauccaguga

SEQ ID NO: 9321 - RNA, 1647 nt, Artificial Sequence
  derived and/or modified sequence opt1 from VP1__Norovirus__AED02034
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucacccuccccauccugacgaucagcgagauguccaacagccgguuccccgugccgaucgacucccugcacaccagccucaccgagaacaucgucgugcagugccagaacgggcgcgugacccuggacggcgagcugauggggacgacccagcuccugcccucccagaucugcgccuuccggggcacccugacccgcagcacgucccgggcgagcgaccaggccgacaccgccacgccccgccucuucaacuacuacuggcacauccagcugaacaaccugaacggcacccccuacgacccggccgaggacauccccgcgccccucgggaccccggacuuccggggcaaggucuucgggguggccagccagcgcaaccccgacuccaccacccgggcccacgaggccaagguggacaccacgagcggccgcuucgcccccaagcuggggucccuggagaucagcaccgagaccgacgacuucaaccagaaccagcccacccgguucacgccggucggcaucggcguggacaacgaggcggacuuccagcaguggucccuccccgacuacagcgggcaguucacccacaacaugaaccuggcccccgccgucgcccccaacuucccgggcgagcagcuccuguucuuccgcucccagcugcccagcuccgggggccggagcuccgggauccuggacugccucgugccccaggagugggugcagcacuucuaccaggagagcgcccccgcgcagacccaggucgcccuggugcgcuacgugaacccggacaccggccgcguccuguucgaggccaagcuccacaagcugggcuucaugacgaucgccaagaacggggacucccccaucaccgugccgcccaacggcuacuuccgguucgagagcugggugaaccccuucuacacccuggcccccauggggaccggcaacgggcgccggcgcauccaguga

SEQ ID NO: 9322 - RNA, 1647 nt, Artificial Sequence
  derived and/or modified sequence opt1 from VP1__Norovirus__AED02035
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucacccuccccauccugacgaucagcgagauguccaacagccgguuccccgugccgaucgacucccugcacaccagccccaccgagaacaucgucgugcagugccagaacgggcgcgugacccucgacggcgagcugauggggacgacccagcugcuccccucccagaucugcgccuuccggggcacccugacccgcagcacgucccggaccggcgaccaggcggacaccgccagcccccgccuguucaacuacuacuggcacauccagcucgacaaccugaacgggaccccguacgaccccgccgaggacauccccgccccgcugggcacgcccgacuuccgggggaaggucuucggcguggccagccagcgcaaccccgacuccaccacccgggcgcacgaggccaagguggacaccacgagcgggcgcuucgcccccaagcucggcucccuggagaucagcaccgaguccgacgacuucgacagcaaccagccgacccgguucacccccgucggcaucgggguggaccgcgagacggacuuccagcaguggacccugcccgaguacuccggccaguucacccacaacaugaaccucgcccccgcggucgccccgaacuuccccggggagcagcugcuguucuuccggagccagcuccccuccagcggcgggcgcuccggcggcauccuggacugccuggugccccaggagugggugcagcacuucuaccaggagagcgccccggcccagacccaggucgcccucgugcgcuacgugaaccccgacacggggcggguccuguucgaggcgaagcugcacaagcucggcuucaugaccaucgccaagaacggggacucccccaucaccgugcccccgaacggcuacuuccgcuucgagagcugggugaaccccuucuacacccuggcccccauggggacgggcaacggccggcgccggauccaguga

SEQ ID NO: 9323 - RNA, 1647 nt, Artificial Sequence
  derived and/or modified sequence opt1 from VP1__Norovirus__AED02037
augaagauggccagcaacgacgccgcgcccuccaacgacggcgccgccgggcuggugccggagaucaacaacgaggccauggcccucgaccccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucacccuccccauccugacgaucagcgagauguccaacagccgguuccccgugccgaucgacucccugcacaccagccccaccgaguccaucgucgugcagugccagaacgggcgcgugacccucgacggcgagcugauggggacgacccagcugcuccccaaccagaucugcgccuuccggggcacccugacccgcagcacgaaccgggcguccgaccaggccgacaccgccacgccccgccuguucaaccaccacuggcacauccagcucgacaaccugaacggcaccccguacgaccccgccgaggacauccccgccccgcuggggacccccgacuuccggggcaaggucuucgggguggcgagccagcgcaaccccgacagcaccacccgggcccacgaggccaagguggacaccacguccggccgcuucacccccaagcucgggagccuggagaucaccaccgaguccgacgacuucgacccgaaccagagcacgaaguucacccccgucggcaucggcguggacaacgaggccgacuuccagcaguggucccugcccgacuacagcgggcaguucacccacaacaugaaccucgcgcccgccgucgccccgaacuuccccggcgagcagcugcuguucuuccggucccagcuccccagcuccgggggccgcagcaacgggauccuggacugccuggugccccaggagugggugcagcacuucuaccaggaguccgccccggcccagacccaggucgcgcucgugcgguacgugaaccccgacacgggccgcguccuguucgaggccaagcugcacaagcucggcuucaugaccaucgccaagaacggggacagccccaucaccgugcccccgaacggcuacuuccgcuucgaguccugggugaaccccuucuacacccuggcccccauggggacgggcaacgggcggcgccggauccaguga

SEQ ID NO: 9324 - RNA, 1647 nt, Artificial Sequence
  derived and/or modified sequence opt1 from VP1__Norovirus__AED02038
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucacccuccccauccugacgaucagcgagauguccaacagccgguuccccgugccgaucgacucccugcacaccagccccaccgagaacaucgucgugcagugccagaacgggcgcgugacccucgacggcgagcugauggggacgacccagcugcuccccucccagaucugcgccuuccggggcacccugacccgcagcacgucccgggcgggcgaccaggccgacaccgccacgccccgccuguucaacuacuacuggcacauccagcucgacaaccugaacgggaccccguacgaccccgccgaggacauccccgccccgcugggcacccccgacuuccgggggaaggucuucggcguggcgagccagcgcaaccccgacagcaccacccgggcccacgaggccaagguggacaccacguccgggcgcuucgcccccaagcucggcagccuggagaucuccaccgagagcuccgacuucgacagcaaccagccgacccgguucacccccgucggcaucgggguggacaacgaggcggacuuccagcaguggucccugcccgacuacagcggccaguucacgcacaacaugaaccucgcccccgccgucgccccgaacuuccccggggagcagcugcuguucuuccgcucccagcuccccagcuccggcgggcggagcaacggcauccuggacugccuggugccccaggagugggugcagcacuucuaccaggaguccgccccggcgcagacccaggucgcccucgugcgcuacgugaaccccgacaccggccgcguccuguucgaggccaagcugcacaagcucggguucaugaccaucgccaagaacggcgacagccccaucacggugcccccgaacggguacuuccgguucgaguccugggugaaccccuucuacacccuggcccccaugggcaccgggaacggccgccggcgcauccaguga

SEQ ID NO: 9325 - RNA, 1647 nt, Artificial Sequence
  derived and/or modified sequence opt1 from VP1__Norovirus__AED02039
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucacccuccccauccugacgaucagcgagauguccaacagccgguuccccgugccgaucgacucccugcacaccagccccaccgagaacaucgucgugcagugccagaacgggcgcgugacccucgacggcgagcugauggggacgacccagcugcuccccucccagaucugcgccuuccggggcacccugacccgcagcacgucccgggcgggcgaccaggccgacaccgccacgccccgccuguucaacuacuacuggcacauccagcucgacaaccugaacgggaccccguacgaccccgccgaggacauccccgccccgcugggcacccccgacuuccgggggaaggucuucggcguggcgagccagcgcaaccccgacagcaccacccgggcccacgaggccaagguggacaccacguccgggcgcuucgcccccaagcucggcagccuggagaucuccaccgagagcuccgacuucgacagcaaccagccgacccgguucacccccgucggcaucgggguggacaacgaggcggacuuccagcaguggucccugcccgacuacagcggccaguucacgcacaacaugaaccucgcccccgccgucgccccgaacuuccccggggagcagcugcuguucuuccgcucccagcuccccagcuccggcgggcggagccacggcauccuggacugccuggugccccaggagugggugcagcacuucuaccaggaguccgccccggcgcagacccaggucgcccucgugcgcuacgugaaccccgacaccggccgcguccuguucgaggccaagcugcacaagcucggguucaugaccaucgccaagaacggcgacagccccaucacggugcccccgaacggguacuuccgguucgaguccugggugaaccccuucuacacccuggcccccaugggcaccgggaacaagcgccggcgcauccaguga

SEQ ID NO: 9326 - RNA, 1623 nt, Artificial Sequence
  derived and/or modified sequence opt1 from VP1__Norovirus__AEG79290
augaagauggccagcaacgacgccaaccccuccgacggcagcgcggccaaccuggugcccgaggucaacaacgaggugauggcccucgagcccguggccggggccgcgcuggccgcccccgucgccggccagcagaacgugaucgaccccuggauccgcaacaacuucgugcaggcgcccgggggcgaguucaccgucagcccccggaacgcccccggggagauccugugguccgcgccccucuccccggaccugaaccccuaccugagccaccucgcccgcauguacaacuccuacgccggcggcuucgagguccaggugauccuggccgggaacgccuucaccgccggcaagaucaucuucgccgccgugccgcccaacuucccgaucgaggggcugagccccucccaggugacgauguucccccacaucaucguggacguccggcagcucgagcccgugcugaucccgcugcccgacgugcgcaacaacuucuaccacuacaaccagagcaacgagcccaccaucaagcucaucgcgaugcuguacacgccccugcgggccaacaacgccggcgaggacgucuucaccguguccugccgcgugcucacccggccgagccccgacuucgacuucaucuuccuggucccgcccaccguggagucccgcaccaagcccuucaccgugcccauccugacggucgaggagaugaccaacagccgguuccccaucccccucgagaagcuguucaccgggccguccagcuccuucguggugcagccccagaacggccgcugcaccacggacggcguccugcucgggaccacccagcugagccccgugaacaucugcaccuuccggggcgacgucacgcacaucgccgggucccgcaacuacaccaugaaccuggccagcaucaacuggaacaacuacgacccgaccgaggagauccccgcgccccucggcacccccgacuucgugggcaagauccaggggaugcugacgcagaccacccggggcgacgggagcacccgcggccaccgggccacgguguacaccggguccgccccguucacccccaagcugggcagcguccaguucaccacggacaccgacaacgacuucgagaccaaccagaacaccaaguucacgcccgugggcgugguccaggacggggacaccgcccaccgcaacgagccccagcagugggugcucccguccuacagcggccggaacgugcagaacguccaccuggcccccgcgguggcccccaccuuccccggggagcagcuccuguucuuccgcuccaccaugccgggcugcagcggguaccccaacauggaccuggacugccugcucccccaggagugggugcagcacuucuaccaggaggccgcccccgcgcaguccgacgucgcccugcugcgguucgugaacccggacacgggccgcguccucuucgagugcaagcugcacaagagcggcuacgugaccguggcccacaccgggcagcacgaccuggugaucccgcccaacggcuacuuccgguucgacuccugggucaaccaguucuacacccucgcccccauggggaacggcaccgggcgccgccgggcccuguga

SEQ ID NO: 9327 - RNA, 1608 nt, Artificial Sequence
  derived and/or modified sequence opt1 from VP1__Norovirus__AEI29586
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggaggugcuccugaaccuggagcucggccccgagcugaacccguaccuggcccaccucucccgcauguacaacggcuacgccgggggcgucgagguccaggugcugcuggccgggaacgccuucaccgccggcaagcucguguucgcggccgugccgccccacuucccccuggagaacaucagccccgggcagaucaccauguucccccacgugaucaucgacguccggacccuggagcccgugcuccugccccugccggacgugcgcaacaacuucuuccacuacaaccagcagaacgagccccggaugcgccucgucgccaugcuguacacgccccugcgguccaacggcagcggcgacgacguguucaccguguccugccgcguccucacccggcccagcccggacuucgacuucaacuaccuggugccgcccaccguggaguccaagacgaagcccuucacccugcccauccucaccaucggggagcugaccaacagccgcuuccccguccccaucgacgagcuguacacgucccccaacgagagccucguggugcagccgcagaacggccggugcgcccuggacggggagcugcagggcaccacccagcuccugcccaccgccaucugcuccuuccgcggccggaucaaccagaaggucagcggggagaaccacguguggaacaugcaggucacgaacaucgacggcacccccuucgacccgaccgaggacgugcccgcgccccuggggacccccgacuucuccggcaagcuguucggggugcucagccagcgcgaccacgacaacgccugccggucccacgacgccgucaucgccacgaacagcgccaaguucaccccgaagcugggcgcgauccagaucggcaccugggagcaggacgacgugcacaucaaccagcccaccaaguucacgcccgugggccucuucgagagcgagggguucaaccaguggacccugcccaacuacuccggggcccugacccucaacaugggccuggccccgcccgucgcccccaccuuccccggggagcagauccuguucuuccgcagccacaucccgcucaagggcggcguggccgaccccgugaucgacugccugcugccccaggaguggauccagcaccucuaccaggaguccgcgcccagccagacggacgucgcccugauccgguucaccaacccggacaccgggcgcgugcuguucgaggccaagcuccaccgguccggcuacaucaccguggccaacacggggagccgccccaucgucgugcccgcgaacggcuacuuccgguucgacuccugggugaaccaguucuacagccuggcccccauggggaccggcaacggccgccgccggguccaguga

SEQ ID NO: 9328 - RNA, 1623 nt, Artificial Sequence
  derived and/or modified sequence opt1 from VP1__Norovirus__AEJ82646
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacguguucaccgccggcaagaucaucuucgcggccgugccgcccaacuucccgaccgaggggcugagccccucccaggucaccauguucccccacaucaucguggacgugcggcagcuggagcccguccucaucccgcugcccgacgugcgcaacaacuucuaccacuacaaccagagcaacgaccccacgaucaagcugaucgccaugcucuacacgccccugcgggccaacaacgccggcgacgacguguucaccgucuccugccgcgugcugacccggccgagccccgacuucgacuucaucuuccucgcgccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcauccaguucuccaccgacaccagcaacgacuucgagacggggcagaacacccgguucacccccgucggcguggugcaggacggguccaccacgcaccagaacgagccccagcaguggguccugcccgacuacagcggccgcgacucccacaacgugcaccucgccccggccguggcccccaccuuccccggggagcagcugcuguucuuccggagcaccaugcccggcugcuccggcuacccgaacaugaaccucgacugccugcugccccaggaguggguccagcacuucuaccaggagagcgcccccgcgcaguccgacguggcccuccugcgcuucgugaaccccgacaccgggcggguccuguucgagugcaagcuccacaagagcggcuacgugaccguggcccacacggggcagcacgaccuggucaucccgcccaacggcuacuuccgcuucgacuccugggugaaccaguucuacacccuggcccccauggggaacggcgcgggccggcgccgcgcccucuga

SEQ ID NO: 9329 - RNA, 1623 nt, Artificial Sequence
  derived and/or modified sequence opt1 from VP1__Norovirus__AER11308
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccaguucuccaccgacaccagcaacgacuucgagacggggcagaacacccgguucacccccgugggcgugguccaggacggguccaccacgcaccagaacgagccccagcagugggugcugcccaacuacagcggccgcgacucccacaacgugcaccucgccccggccgucgcccccaccuuccccggggagcagcugcuguucuuccggagcaccaugcccggcugcuccggcuacccgaacaugaaccucgacugccugcugccccaggagugggugcagcacuucuaccaggagagcgcccccgcgcaguccgacguggcccuccugcgcuucgucaaccccgacaccgggcgggugcuguucgagugcaagcuccacaagagcggcuacgugaccgucgcccacacggggcagcacgaccuggugaucccgcccaacggcuacuuccgcuucgacuccugggugaaccaguucuacacccuggcccccauggggaacggcgcgggccggcgccgcgcccucuga

SEQ ID NO: 9330 - RNA, 1623 nt, Artificial Sequence
  derived and/or modified sequence opt1 from VP1__Norovirus__AER11310
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacggugaaccuggccucccagaacuggaacaacuacgacccgaccgaggagauccccgcgccccuggggacccccgacuucgucggcaagauccagggggugcucacccagacgacccgccgggacggcagcacccgcgggcacaaggccaccguguccacgggcagcguccacuucaccccgaagcugggcagcgugcaguucuccaccgacaccagcaacgacuucgagacggggcagaacacccgguucacccccgugggcgucgugcaggacggguccaccacgcaccagaacgagccccagcagugggugcugcccaacuacagcggccgcgacucccacaacguccaccucgccccggccguggcccccaccuuccccggggagcagcugcuguucuuccggagcaccaugcccggcugcuccggcuacccgaacaugaaccucgacugccugcugccccaggagugggugcagcacuucuaccaggagagcgcccccgcgcaguccgacgucgcccuccugcgcuucgugaaccccgacaccgggcgggugcuguucgagugcaagcuccacaagagcggcuacgucaccguggcccacacggggcagcacgaccuggugaucccgcccaacggcuacuuccgcuucgacuccugggucaaccaguucuacacccuggcccccauggggaacggcgcgggccggcgccgcgcccucuga

SEQ ID NO: 9331 - RNA, 1623 nt, Artificial Sequence
  derived and/or modified sequence opt1 from VP1__Norovirus__AER11312
augaagaucgccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccuccacccaggaguacaccaugaaccuggccagccagaacuggaacaacuacgacccgacggaggagauccccgcgccccugggcacccccgacuucgugggcaagauccaggggguccucacccagaccacgcggcgggacggcagcacccgcgggcacaaggccaccguguccaccggcagcgugcacuucacgccgaagcuggggcggauccaguucuccaccgacaccagcaacgacuucgagaccggccagaacacgcgcuucacccccgucggcguggugcaggacggguccaccacccaccagaacgagccccagcaguggguccugcccaacuacagcggccgggacucccacaacgugcaccucgccccggccguggcccccagcuuccccggggagcagcugcuguucuuccgcuccacgaugcccggcugcagcggguacccgaacaugaaccucgacugccugcugccccaggaguggguccagcacuucuaccaggaggccgcgcccgcccaguccgacguggcccuccugcgguucgugaaccccgacaccggccgcguccuguucgagugcaagcuccacaagagcggcuacgugaccguggcccacaccgggcagcacgaccuggucaucccgcccaacggcuacuuccgguucgacuccugggugaaccaguucuacacccuggcgcccauggggaacggcacggggcgccgccgggcccucuga

SEQ ID NO: 9332 - RNA, 1623 nt, Artificial Sequence
  derived and/or modified sequence opt1 from VP1__Norovirus__AER11314
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggacccgcaacuacaccaugaaccuggccagccugaacuggaacaacuacgaccccacggaggagaucccggcgccccucggcacccccgacuucguggggaagauccagggcguccugacccagaccacgaagggggacggcuccacccggggccacaaggccaccguguacaccgggagcgcccccuucacgccgaagcugggcuccgugcaguucagcaccgacaccgagaacgacuucgagacccaccagaacacgaaguucacccccgucggggugauccaggacggcgggaccacccaccgcaacgagccccagcagugggugcuccccagcuacuccggccggaacguccacaacgugcaccuggccccggccguggcgcccacguuccccggcgagcagcuccucuucuuccgcagcaccaugcccgggugcuccggcuacccgaacauggaccuggacugccugcucccccaggaguggguccagcacuucuaccaggaggccgcccccgcccagagcgacguggcgcugaugcgguucgugaaccccgacaccgggcgcguccuguucgagugcaagcuccacaaguccggcuacgugaccguggcccacaccgggcagcacgaccuggucaucccgcccaacggcuacuuccgguucgacagcugggugaaccaguucuacacgcuggcccccaugggcaacgggaccggccgccggcgcgcccucuga

SEQ ID NO: 9333 - RNA, 1623 nt, Artificial Sequence; identical to SEQ ID NO: 9292
  derived and/or modified sequence opt1 from VP1__Norovirus__AER11316

SEQ ID NO: 9334 - RNA, 1623 nt, Artificial Sequence; identical to SEQ ID NO: 9292
  derived and/or modified sequence opt1 from VP1__Norovirus__AER11318

SEQ ID NO: 9335 - RNA, 1623 nt, Artificial Sequence
  derived and/or modified sequence opt1 from VP1__Norovirus__AER11320
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucgucguggacgugcggcagcuggagcccguccucaucccgcugcccgacgugcgcaacaacuucuaccacuacaaccagagcaacgacuccaccaucaagcugaucgccaugcucuacacgccccugcgggcgaacaacgccggcgaggacguguucaccgucagcugccgcgugcugacccggcccuccccggacuucgacuucaucuuccucgugccgcccaccgucgagagccgcaccaagcccuucacggugcccauccugaccguggaggagaugaccaacucccgguuccccaucccccuggagaagcuguucaccggccccagcggggccuucgucgugcagccgcagaacggccgcugcacgaccgacgggguccugcugggcaccacccagcucucccccgugaacaucugcacguuccggggcgacgugacccacaucgccgggagccgcaacuacaccaugaaccuggccucccugaacuggaacaacuacgaccccaccgaggagaucccggcgccccucggcacgcccgacuucgucgggaagauccagggcgugcugacccagaccaccaagggggacggcagcacgcggggccacaaggccaccguguacaccggguccgcccccuucaccccgaagcugggcagcguccaguucagcacggacaccgagaacgacuucgagacccaccagaacaccaaguucacgcccgugggggugauccaggacggcuccaccacccaccgcaacgagccccagcaguggguccuccccagcuacuccgggcggaacgugcacaacgugcaccuggccccggccgucgcgcccaccuuccccggcgagcagcuccucuucuuccgcagcacgaugcccggcugcuccggguacccgaacauggaccuggacugccugcucccccaggagugggugcagcacuucuaccaggaggccgcccccgcccagagcgacguggcgcugcugcgguucgucaaccccgacaccggccgcguccucuucgagugcaagcugcacaaguccggguacgugaccguggcccacaccggccagcacgaccuggugaucccgcccaacggguacuuccgguucgacagcugggugaaccaguucuacacccucgcccccaugggcaacggcacggggcgccggcgcgcccuguga

SEQ ID NO: 9336 - RNA, 1623 nt, Artificial Sequence; identical to SEQ ID NO: 9292
  derived and/or modified sequence opt1 from VP1__Norovirus__AER11324

SEQ ID NO: 9337 - RNA, 1623 nt, Artificial Sequence
  derived and/or modified sequence opt1 from VP1__Norovirus__AER11326
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuaccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccgggggcgcccccuucaccccgaagcugggguccgugcaguucagcacggacaccgagaacgacuucgagacccaccagaacaccaaguucacgcccgucggcgugauccaggacgggagcaccacccaccgcaacgagccccagcagugggugcuccccuccuacagcggccggaacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcgcccuguga

SEQ ID NO: 9338 - RNA, 1623 nt, Artificial Sequence; identical to SEQ ID NO: 9305
  derived and/or modified sequence opt1 from VP1__Norovirus__AER11328

SEQ ID NO: 9339 - RNA, 1623 nt, Artificial Sequence
  derived and/or modified sequence opt1 from VP1__Norovirus__AER11330
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagacgccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcuccaccacccaccgcaacgagccccagcagugggugcuccccagcuacuccgggcggaacguccacaacgugcaccuggccccggccguggcgcccacguuccccggcgagcagcuccucuucuuccgcagcaccaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacgcucgcccccaugggcaacggcaccgggcgccggcgcgcccuguga

SEQ ID NO: 9340 - RNA, 1623 nt, Artificial Sequence; identical to SEQ ID NO: 8840
  derived and/or modified sequence opt1 from VP1__Norovirus__AER11332

SEQ ID NO: 9341 - RNA, 1623 nt, Artificial Sequence; identical to SEQ ID NO: 9305
  derived and/or modified sequence opt1 from VP1__Norovirus__AER11334

SEQ ID NO: 9342 - RNA, 1623 nt, Artificial Sequence
  derived and/or modified sequence opt1 from VP1__Norovirus__AER11336
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccgcgcugaacuggaacaacuacgaccccaccgaggagaucccggcgccccucggcacgcccgacuucguggggaagauccagggcguccugacccagaccaccaaggccgacgggagcacgcggggccacaaggccaccguguacaccggcuccgccgacuucacccccaagcuggggagcgugcaguucaacacggacaccgagaacgacuucgagacccaccagaacaccaaguucacgccggucggcgugauccaggacgggagcaccacccaccgcaacgagccccagcagugggugcuccccuccuacagcggccggaacguccacaacgugcaccuggcccccgccguggccccgaccuuccccggggagcagcuccucuucuuccgcuccacgaugcccggcugcagcggcuaccccaacauggaccuggacugccugcucccgcaggaguggguccagcacuucuaccaggaggccgcgcccgcccaguccgacguggcccugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcgcgcuguga

SEQ ID NO: 9343 - RNA, 1623 nt, Artificial Sequence
  derived and/or modified sequence opt1 from VP1__Norovirus__AER11340
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccgcgcugaacuggaacaacuacgaccccaccgaggagaucccggcgccccucggcacgcccgacuucguggggaagauccagggcguccugacccagaccaccaaggccgacgggagcacgcggggccacaaggccaccguguacaccggcuccgccgacuucacccccaagcuggggagcgugcaguucagcacggacaccgagaacgacuucgagacccaccagaacaccaaguucacgccggucggcgugauccaggacggguccaccacccaccgcaacgagccccagcagugggugcuccccagcuacuccggccggaacguccacaacgugcaccuggcccccgccguggccccgaccuuccccggggagcagcuccucuucuuccgcagcacgaugcccggcugcuccggcuaccccaacauggaccuggacugccugcucccgcaggaguggguccagcacuucuaccaggaggccgcgcccgcccagagcgacguggcccugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcgcuguga

SEQ ID NO: 9344 - RNA, 1623 nt, Artificial Sequence; identical to SEQ ID NO: 9343
  derived and/or modified sequence opt1 from VP1__Norovirus__AER11342

SEQ ID NO: 9345 - RNA, 1623 nt, Artificial Sequence
  derived and/or modified sequence opt1 from VP1__Norovirus__AER11344
augaagauggccagcaacgacgccucccccagcgacggcuccgcggccaaccuggugccggaggucaacaacgaggugauggcccucgagcccguggucggggccgccaucgcggcccccguggccggccagaagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccgcgcugaacuggaacaacuacgaccccaccgaggagaucccggcgccccucggcacgcccgacuucguggggaagauccagggcguccugacccagaccaccaaggccgacgggagcacgcggggccacaaggccaccguguacaccggcuccgccgacuucacccccaagcuggggagcgugcaguucagcacggacaccgagaacgacuucgagacccaccagaacaccaaguucacgccggucggcgugauccaggacggguccaccacccaccgcaacgagccccagcagugggugcuccccagcuacuccggccggaacguccacaacgugcaccuggcccccgccguggccccgaccuuccccggggagcagcuccucuucuuccgcagcacgaugcccggcugcuccggcuaccccaacauggaccuggacugccugcucccgcaggaguggguccagcacuucuaccaggaggccgcgcccgcccagagcgacguggcccugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcgcuguga

SEQ ID NO: 9346 - RNA, 1623 nt, Artificial Sequence; identical to SEQ ID NO: 9343
  derived and/or modified sequence opt1 from VP1__Norovirus__AER11346

SEQ ID NO: 9347 - RNA, 1623 nt, Artificial Sequence
  derived and/or modified sequence opt1 from VP1__Norovirus__AER11348
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcuguccagcucccaggugaccauguucccccacaucaucgucgacgugcggcagcuggagcccgugcucaucccccugccggacguccgcaacaacuucuaccacuacaaccagagcuccgacagcaccaucaagcugaucgccaugcucuacacgccccugcgggcgaacaacgccggcgaggacguguucaccguguccugccgcguccugacccggcccagccccgacuucgacuucaucuuccucgugccgcccaccguggagucccgcaccaagcccuucacgguccccauccugaccguggaggagaugaccaacagccgguucccgaucccccuggagaagcuguucaccggccccuccggggccuucgugguccagccccagaacggccgcugcacgaccgacggggugcugcugggcaccacccagcucagcccggucaacaucugcacguuccggggcgacgugacccacaucgccgggucccgcaacuacaccaugaaccuggccgcgcugaacuggaacaacuacgaccccaccgaggagauccccgccccgcucggcacgcccgacuucguggggaagauccagggcguccugacccagaccaccaaggccgacgggagcacgcggggccacaaggccaccguguacaccggcagcgccgacuucacccccaagcugggguccgugcaguucagcacggacaccgagaacgacuucgagacccaccagaacaccaaguucacgcccgucggcgugauccaggacggguccaccacccaccgcaacgagccgcagcagugggugcuccccagcuacuccggccggaacguccacaacgugcaccuggcgcccgccguggcccccaccuucccgggggagcagcuccucuucuuccgcagcacgaugcccggcugcuccggcuaccccaacauggaccuggacugccugcucccccaggaguggguccagcacuucuaccaggaggccgcgccggcccagagcgacguggcccugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcgcuguga

SEQ ID NO: 9348 - RNA, 1623 nt, Artificial Sequence
  derived and/or modified sequence opt1 from VP1__Norovirus__AER11350
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacgggcgcugcacgaccgacggcguguuccucgggaccacccagcugagccccgucaacaucugcacguuccggggcgacgugacccacaucaccggcucccgcaacuacaccaugaaccucgccacgcagaacuggaacagcuacgacccgaccgaggagauccccgcgccccuggggacccccgacuucgugggcaagauccaggggguccugacccagacgacccgggccgacggcagcacccgcgggcacaaggccaccguguacacgggcuccgccgacuucgccccgaagcucggccgggugcaguucgccaccgacaccgacaacgacuucgacgccaaccagaacaccaaguucacgcccgucggggugauccaggacggcgacaccgcgcaccgcaacgagccccagcagugggugcugcccagcuacuccgggcggaacagccacaacguccaccuggccccggccguggcccccaccuuccccggcgagcagcuccuguucuuccgcuccaccaugcccgggugcagcggcuacccgaacauggaccuggacugccuccugccccaggagugggugcaguacuucuaccaggaggcggcccccgcccaguccgacgucgcccugcuccgguucgugaaccccgacacgggccgcgugcuguucgagugcaagcugcacaagagcggguacgucaccguggcccacaccggccagcacgaccucgugaucccgcccaacggguacuuccgguucgacuccugggucaaccaguucuacacccuggcgcccaugggcaacgggaccggccgccgccgggcccuguga

SEQ ID NO: 9349 - RNA, 1623 nt, Artificial Sequence
  derived and/or modified sequence opt1 from VP1__Norovirus__AER11352
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcgggaccgcgcaccgcaacgagccccagcagugggugcugcccuccuacagcggccggaacucccacaacguccaccucgccccggccguggcccccaccuuccccggggagcagcugcuguucuuccgcagcaccaugcccggcugcuccggcuacccgaacauggaccucgacugccugcugccccaggagugggugcaguacuucuaccaggaggcggcccccgcccagagcgacgucgcccuccugcgguucgugaaccccgacacggggcgcgugcuguucgagugcaagcuccacaaguccggcuacgucaccguggcccacaccgggcagcacgaccuggugaucccgcccaacggcuacuuccgguucgacagcugggucaaccaguucuacacccuggcgcccauggggaacggcaccggccgccgccgggcccucuga

SEQ ID NO: 9350 - RNA, 1623 nt, Artificial Sequence
  derived and/or modified sequence opt1 from VP1__Norovirus__AER11354
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucgccacggacaccgagaacgacuucgagacccaccagaacaccaaguucacgccggucggcgugauccaggacggguccaccacccaccgcaacgagccccagcagugggugccgcccagcuacuccggccggaacguccacaacgugcaccucgcccccgcgguggcccccaacuuccccggggagcagcugcuguucuuccgcagcaccaugcccggcugcuccggcuacccgaacauggaccucgacugccugcugccccaggaguggguccagcacuucuaccaggaggccgcccccgcgcagagcgacguggcccuccugcgguucgugaaccccgacacggggcgcguccuguucgagugcaagcuccacaaguccggcuacgugaccguggcccacaccgggcagcacgaccuggucaucccgcccaacggcuacuuccgguucgacagcugggugaaccaguucuacacccuggcccccauggggaacggcaccggccgccggcgcgcccucuga

SEQ ID NO: 9351 - RNA, 1623 nt, Artificial Sequence
  derived and/or modified sequence opt1 from VP1__Norovirus__AER11356
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucgccacggacaccgagaacgacuucgagacccaccagaacaccaaguucacgccggucggcgugauccaggacggguccaccacccaccgcaacgagccccagcagugggugcuccccagcuacuccggccggaacguccacaacgugcaccuggcccccgcgguggccccgaacuuccccggggagcagcuccucuucuuccgcagcaccaugcccggcugcuccggcuaccccaacauggaccuggacugccugcucccgcaggaguggguccagcacuucuaccaggaggccgcccccgcgcagagcgacguggcccugcugcgguucgugaaccccgacacggggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcaccggccgccggcgcgcccuguga

SEQ ID NO: 9352 - RNA, 1623 nt, Artificial Sequence; identical to SEQ ID NO: 8842
  derived and/or modified sequence opt1 from VP1__Norovirus__AER11358

SEQ ID NO: 9353 - RNA, 1623 nt, Artificial Sequence
  derived and/or modified sequence opt1 from VP1__Norovirus__AER11360
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccaccugaucgucgacgugcggcagcucgagcccgugcugaucccgcugcccgacguccgcaacaacuucuaccacuacaaccaguccaacgacagcaccaucaagcucaucgccaugcuguacacgccccugcgggccaacaacgcgggcgacgacguguucaccguguccugccgcguccucacccggcccagcccggacuucgacuucaucuuccuggugccgcccaccguggagucccgcacgaagcccuucagcguccccgugcugaccguggaggagaugaccaacucccgguuccccaucccccucgagaagcuguucaccggccccagcuccgccuucgucgugcagccgcagaacgggcgcugcacgaccgacggcguccugcucgggaccacccagcugagccccgugaacaucugcacguuccggggcgacgugacccacauccccggcucccgcaacuacaccaugaaccuggccagccagaacuggaacagcuacgacccgaccgaggagauccccgcgccccucgggacgcccgacuucgucggcaagauccagggggugcugacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccucccguccuacagcgggcggaacauccacaacgugcaccuggcccccgccguggcccccaccuuccccggcgagcagcuccuguucuuccgcuccaccaugccggggugcagcggcuaccccaacauggaccuggacugccugcucccccaggaguggguccaguacuucuaccaggaggcggcccccgcccaguccgacguggcccugcugcgguucgugaacccggacaccggccgcguccucuucgagugcaagcugcacaagagcggguacgugaccguggcgcacaccggccagcacgaccuggucaucccgcccaacggguacuuccgguucgacuccugggugaaccaguucuacacccucgcccccaugggcaacgggacgggccgccgccgggcccuguga

SEQ ID NO: 9354 - RNA, 1647 nt, Artificial Sequence
  derived and/or modified sequence opt1 from VP1__Norovirus__AEX10549
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaccgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcuggucgccaugcuguacaccccgcuccgcgccaacaacuccggcgacgacguguucacggugagcugccggguccugacccgccccucccccgacuucagcuucaacuuccuggugcccccgaccguggaguccaagaccaagcccuucacgcuccccauccugaccaucagcgagauguccaacagccgguuccccgucccgaucgacucccugcacaccagccccaccgacaacaucguggugcagugccagaacgggcgcgucacgcucgacggcgagcugauggggaccacccagcugcuccccucccagaucugcgccuuccggggcgugcugacccgcagcacgucccgggcgagcgaccaggccgacaccgccacgccccgccuguucaacuaccacuggcacauccagcucgacaaccugaacggcaccccguacgaccccgccgaggacauccccgccccgcuggggacccccgacuuccggggcaagguguucggggucgcgagccagcgcaaccccgacuccaccacccgggcccacgaggccaagguggacaccacgagcggccgcuucacccccaagcucgggucccuggagaucagcaccgaguccggcgacuucgaccagaaccagccgacccgguucacgcccgucggcaucgggguggacaacgaggccgacuuccagcaguggacccugcccgacuacagcggccaguucacccacaacaugaaccucgcgcccgccguggccccgaacuuccccggggagcagcugcuguucuuccgcucccaccuccccagcuccggcgggcggagcaacggcauccuggacugccuggucccccaggagugggugcagcacuucuaccaggaguccgccccggcccagacccagguggcgcucguccgcuacgugaaccccgacacgggccgcgugcuguucgaggccaagcugcacaagcucggguucaugaccaucgccaagagcggcgacucccccaucaccgugcccccgaacggguacuuccgguucgagagcugggugaaccccuucuacacccuggcccccaugggcacggggaacggccgccggcgcauccaguga

SEQ ID NO: 9355 - RNA, 1623 nt, Artificial Sequence
  derived and/or modified sequence opt1 from VP1__Norovirus__AEX91910
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagacgcccgcgccccuggggaccccggacuucgucggcaagauccagggggugcucacccagaccacgcggaccaacggcagcacccgcgggcacaaggccaccguguacacgggcuccgccgacuucagccccaagcugggccggguccaguucgccaccgacaccgacaacgacuucgagaccaaccagaacacgaaguucacccccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacgcuggcccccaugggcaacgggaccggccgccgccgggcccucuga

SEQ ID NO: 9356 - RNA, 1737 nt, Artificial Sequence
  derived and/or modified sequence opt1 from VP1__Norovirus__AFD30970
augaagauggccagcuccgacgccacccccagcuccgacggcgcggggaaccuggugccggagagccagcaggagguccucccccuggcccccguggccggcgccgcccuggcggcccccguggucgggcagcagaacaucaucgacccguggaucaaggagaacuucgugcaggcgccccagggcgaguucaccgugucccccaagaacagccccggggagguccucgugaaccuggagcuguccccgcgccucaaccccuaccuggaccaccugagcaagauguacaacgccuacgcgggcggcauggagguggagaucauccucgccgggaacgccuucacggccggcaagguccugaucgccgcggugccgcccaacuuccccaucgagaacaucuccgccagccaggccucccaguucccccacgugaucgucgacgugcggacccuggagcccauccgccucccccugccggacgugcggaccaacuucuuccacuacaccacgcaggaggagccccgcaugcggaucgucgccuggcuguacacgccccuccgcaccaacgggagcggcgacgacuccuucaccgugagcgggcggauccugacccgccccuccccggacuucgaguucagcuuccuggugccgcccaccgucgagaccaagaccguguccuucagcgugcccggccucgucguggaggacauguccaacagccgguggcccgcccagaucaacggccuggugguccgcgggaacgaggcccaggugguccacuuccagaacggccggugcacgaccgaggggacccugcucggcaccacgacccugagcaucaacuccaucugcggccugcgcgggcucagcgugucccaggccagcgugcggggcgcccccgcccugaccgaggagaugccgccccuggaggacgaggucgccgacggggcggccgccaccuacacgcucgcccgcgccgcggacaccacccuguggcugcggguggaggagcccgacggccgccccuacgacaucuucggggaccagcccgccccgcucggcacccccgacuucacggccgugaucgucggcaccgccauccggccccgcaccgcguccggggccuaccugcacgacgccuacguggacaccacgcccggcgacgccgacuucaccccgagcaccgggaacaccaagaucgugcugcggggcgggggcuccggccacgucgggcagggccacuacuggcaguuccgccccaucgccguggagggcggcgggagccggccccaguaccaggaguacaaccuccccgacuacgcggggccgacggccuccaaccacgaccuggccccgcccguggcgccccgcaugcccggcgagcugcuccugcuguucgagagcgacaugcccgucugggacaacggggccggcgccgcccccgcccagaagauccacugccuccugcccaacgaguucaucacccaccuguucgaccuccaggccccggcccuggcggaggccgcccugcuccgcuacgugcaccccgacuccgggcggacccuguucgagugcaagcuguaccgcgagggcuacaugguggucgccgcgcccgccggccggcucaacuucccccuggacggguacuuccgcuucgacagcuggguguccgccuucuacauccugagcccggugggcuccgggcagggccggcgcgggcggagcaaggccgccuga

SEQ ID NO: 9357 - RNA, 1623 nt, Artificial Sequence
  derived and/or modified sequence opt1 from VP1__Norovirus__AFH88383
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgguccagggcauguucaugucccccgacgugaaccagagcgugcaguuccagaacgggcgcugccagaucgacggccagcugcaggggaccacccccgucucccucagccagcugugcaagauccggggcaagacguccagcaacgcccgcgugcugaaccucagcgaggucgacgggacccccuucaucccgcuggagucccccgcccccgugggcuucccggaccugggcgggugcgacuggcacgugaacuucaccuuccaggcgcagaaccaggaccccagccaguccgucaccuucgccacgaacgacgccagcuucgugcccuaccucggcuccaucagcccccacaacgggggcgacuuccacgccggggacaucaucggcucccugggcuggaucagcgccccguccgacaacagccagcugaacguguggaccauccccaaguacggguccagccuccccgacgucacccaccuggcgcccgccguguucccgcccggcuucggggaggugauccuguacuucuacuccaccuuccccggcagcgggcagcccucccagcuccaggucccgugccugcugccccaggaguucaucacgcacuucugcaacgagcaggcccccaucgccggcgaggcggcccuccugcacuacguggaccccgacaccggccggaaccugggggaguucaagcucuacccggacggcuucaugaccugcgugcccaacagcgucuccagcgggccccagacccugcccaucaacggcguguucguguucgucuccugggugagccgcuucuaccagcugaagccggugggcacggccagcgccgcccggcgccucgggcugcggcgcaucuga

SEQ ID NO: 9358 - RNA, 1671 nt, Artificial Sequence
  derived and/or modified sequence opt1 from VP1__Norovirus__AFJ21376
augaagauggccagcuccgacgccgcgcccagcaccgacggcgccgggaaccuggugccggagucccagcaggagguccucccccuggcccccguggccggcgccgcgcuggccgcccccguggucgggcagaccaacaucaucgacccguggaucaaggagaacuucgugcaggcgccccagggcgaguucacggugagccccaagaacucccccggggagauccucgucaaccuggagcugggcccgaagcucaaccccuaccuggaccaccugagccgcauguacaacuccuacgccggcgggaucgacgugauggugguccucgccggcaacgccuucaccgccgggaaggugcugaucgccgcgaucccgcccaacuuccccguggagggcgucagcgccucccaggccacccaguucccccacgugaucaucgacgugcggacccuggaccccguccgccucccccugccggacgugcggagcacguucuuccacuacaccaacgacaccgagcccaagaugcgccuggugaucuggcucuacacgccccugcggaccaacggguccggcgacgacagcuucaccgucuccggccgcauccugacccggcccagccaggacuucgaguucgccuuccucaucccgcccaccguggagacgaagaccacccccuucuccgugcccggguucagcguccaggagauguccaacagccgcuggccggccgcgaucuccgccaugguggugcggggcaacgagccccaggucgugcaguuccagaacgggcgcgcccaccuggacggcaugcugcucggcaccacgcccgucagccccaacuacaucgccagcuaccgggggaucuccaccggcaacagccgcuccgccagcuccgaggcggacgagcgggccguggggagcuucgacguguggguccgccugcaggagccggacggccagcccuacgacaucuucgggaagcagcccgccccgaucggcacccccgacuucaaggccgugaucgugggcuucgccgcgcggccccugaccuccgggagcuacgccaacgaggccuacgucaacacgaccgccuccgacuacgcgcccgccaccggcaacaugcgcuucaccgugcggaacgggggcacggggcacaucagcgccaacaaguacugggaguucaaguccuucggcguggagggcgagcgccacaccgacauccaguaccaggaguacgagcucccggacuacagcgggcaggucgccuccaaccacaaccuggccccgcccguggcgccccggaugcccggcgagagccugcuccuguuccaguccaacaugcccgugugggacgacgggcacggcgagagcacccccaagaagauccacugccugcucccccaggaguucaucgggcacuucuucgaccgccaggccccgucccugggcgacgccgcccugcuccgguacgucaaccaggagaccaaccgcgugcuguucgagugcaagcuguaccgcgacggcuacaucacgguggccgcgagcuccgggcuccuggacuucccccuggacggcuucuuccgguucgacagcugggucagcuccuucuacauccucagccccgugggguccggccagggccgccgggggcgcgugcgguuccaguga

SEQ ID NO: 9359 - RNA, 1608 nt, Artificial Sequence
  derived and/or modified sequence opt1 from VP1__Norovirus__AFJ21379
augaagauggccagcuccgacgccgcgcccagcaacgacggcgccgccgggcuggugccggaggucaacaacgagaccauggcccucgagcccguggccggcgcguccaucgccgcgccccugaccgggcagaacaacgugaucgaccccuggauccgccugaacuucguccaggccccgaacggcgaguucacggugagcccccggaacucccccggggaggugcuccugaaccuggagcucggccccgagcugaacccguaccuggcccaccucagccgcauguacaacggcuacgccgggggcgucgagguccaggugcugcuggccgggaacgccuucaccgccggcaagcucguguucgcggccgugccgccccacuucccccuggagaacaucucccccgggcagaucaccauguucccccacgugaucaucgacguccggacccuggagcccgugcuccugccccugccggacgugcgcaacaacuucuuccacuacaaccagcagaacgagccccggaugcgccucgucgccaugcuguacacgccccugcggagcaacggcuccggcgacgacguguucaccgugagcugccgcguccucacccggcccuccccggacuucgacuucaacuaccuggugccgcccaccguggagagcaagacgaagcccuucacccugcccauccucaccaugggggagcugaccaacucccgcuuccccguccccaucgacgagcuguacacgagccccaacgagucccucguggugcagccgcagaacggccggugcgcccuggacggggagcugcagggcaccacccagcuccugcccaccgccaucugcagcuuccgcggccggaucaaccagaaggucuccggggacaaccacguguggaacaugcaggucacgaacaucaacggcacccccuucgacccgaccgaggacgugcccgcgccccuggggacccccgacuucagcggcaagcuguucggggugcucucccagcgcgaccacgacaacgccugccggagccacgacgccgucaucgccacgaacagcgccaaguucaccccgaagcugggcgcgauccagaucggcaccugggagcaggacgacgugcacaucaaccagcccaccaaguucacgcccgugggccucuucgaguccgagggguucaaccaguggacccugcccaacuacagcggggcccugacccucaacaugggccuggccccgcccgucgcccccaccuuccccggggagcagauccuguucuuccgcucccacaucccgcucaagggcggcguggccgaccccgugaucgacugccugcugccccaggaguggauccagcaccucuaccaggagagcgcgcccucccagacggacgucgcccugauccgguucaccaacccggacaccgggcgcgugcuguucgaggccaagcuccaccggagcggcuacaucaccguggccaacacggggucccgccccaucgucgugcccgcgaacggcuacuuccgguucgacagcugggugaaccaguucuacucccuggcccccauggggaccggcaacggccgccgccggguccaguga

SEQ ID NO: 9360 - RNA, 1608 nt, Artificial Sequence; identical to SEQ ID NO: 9048
  derived and/or modified sequence opt1 from VP1__Norovirus__AFJ21382

SEQ ID NO: 9361 - RNA, 1623 nt, Artificial Sequence
  derived and/or modified sequence opt1 from VP1__Norovirus__AFJ21387
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccaucuacaccggguccgcccccuucaccccgaagcugggcagcgugcaguucagcacggacaccgagaacgacuucgagacccaccagaacaccaaguucacgcccgugggggucauccaggacggcuccaccacccaccgcaacgagccccagcagugggugcuccccagcuacuccgggcggaacgugcacaacguccaccuggccccggccguggcgcccaccuuccccggcgagcagcuccucuucuuccgcagcacgaugcccggcugcuccggguacccgaacauggaccuggacugccugcucccccaggagugggugcagcacuucuaccaggaggccgcccccgcccagagcgacgucgcgcugcugcgguucgugaaccccgacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcacggggcgccggcgcgcccuguga

SEQ ID NO: 9362 - RNA, 1623 nt, Artificial Sequence; identical to SEQ ID NO: 9282
  derived and/or modified sequence opt1 from VP1__Norovirus__AFJ21388

SEQ ID NO: 9363 - RNA, 1623 nt, Artificial Sequence; identical to SEQ ID NO: 9292
  derived and/or modified sequence opt1 from VP1__Norovirus__AFJ21389

SEQ ID NO: 9364 - RNA, 1623 nt, Artificial Sequence
  derived and/or modified sequence opt1 from VP1__Norovirus__AFJ21390
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucgccggcucccgcaacuacgccaugaaccuggcgagccugaacuggaacaacuacgaccccaccgaggagaucccggcgccccucgggacccccgacuucgugggcaagauccaggggcugcugacgcagaccaccaagggcgacggguccacccggggccacaaggccacggucuacaccggcagcgcccccuucaccccgaagcucgggagcgugcaguucuccaccgacacggagaacgacuucgagacccaccagaacaccaaguucacccccgugggcgucauccaggacgggagcacgacccaccgcaacgagccccagcagugggugcugcccuccuacagcggccggaacgugcacaacguccaccuggccccggccguggcccccaccuuccccggggagcagcuccuguucuuccgcuccaccaugcccggcugcagcggcuacccgaacauggaccuggacugccuccugccccaggagugggugcagcacuucuaccaggaggccgcccccgcgcaguccgacgucgcccugcuccgguucgugaaccccgacacggggcgcgugcuguucgagugcaagcugcacaagagcggcuacgucaccguggcccacaccgggcagcacgaccucgugaucccgcccaacggcuacuuccgguucgacuccugggucaaccaguucuacacccuggcccccauggggaacggcaccggccgccggcgcgcccuguga

SEQ ID NO: 9365 - RNA, 1623 nt, Artificial Sequence
  derived and/or modified sequence opt1 from VP1__Norovirus__AFJ21391
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcuccgaccccaccaucaagcugaucgccaugcucuacacgccccugcgggccaacaacgcgggggacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacggccgcugcacgaccgacggggugcuccugggcaccacccagcucucccccgucaacaucugcacguuccgcggggacgugacccacaucgccggcacccaggaguacaccaugaaccuggccagccagaacuggaacaacuacgacccgacggaggagauccccgcgccccugggcacccccgacuucguggggaagauccagggcguccucacccagaccacgcggcgggacgggagcacccgcggccacaaggccaccguguccaccgggagcgugcacuucacgccgaagcugggccggauccaguucuccaccgacaccagcaacgacuucgagaccggccagaacacgcgcuucacccccgucgggguggugcaggacggcuccaccacccaccagaacgagccccagcaguggguccugcccaacuacagcgggcgggacucccacaacgugcaccucgccccggccguggcccccagcuuccccggcgagcagcugcuguucuuccgcuccacgaugcccgggugcagcggcuacccgaacauggaccucgacugccugcugccccaggaguggguccagcacuucuaccaggaggccgcgcccgcccaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcgcccaugggcaacgggacgggccgccgccgggcccucuga

SEQ ID NO: 9366 - RNA, 1623 nt, Artificial Sequence
  derived and/or modified sequence opt1 from VP1__Norovirus__AFJ21392
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgaggacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccggggccuucgugguccagccgcagaacggccgcugcaccaccgacggggugcugcugggcaccacgcagcucagccccgucaacaucugcaccuuccggggcgacgugacccacaucgccgggucccgcaacuacaccaugaaccuggccagccugaacuggaacaacuacgaccccacggaggagaucccggcgccccucggcacccccgacuucguggggaagauccagggcguccugacccagaccacgaagggggacggcuccacccggggccacaaggccaccguguacaccgggagcgcccccuucacgccgaagcugggcagcgugcaguucuccaccgacaccgagaacgacuucgagacccaccagaacacgaaguucacccccgucggggugauccaggacggcagcaccacccaccgcaacgagccccagcagugggugcuccccuccuacagcgggcggaacguccacaacgugcaccuggccccggccguggcccccacguuccccggcgagcagcuccucuucuuccgcuccaccaugcccggcugcagcggguacccgaacauggaccuggacugccugcucccccaggaguggguccagcacuucuaccaggaggcggcccccgcccaguccgacguggcccugcugcgguucgugaaccccgacaccggccgcguccucuucgagugcaagcugcacaagagcggguacgugaccguggcgcacaccggccagcacgaccuggucaucccgcccaacggguacuuccgguucgacgccugggugaaccaguucuacacgcucgcccccaugggcaacggcaccgggcgcaagcgggcccuguga

SEQ ID NO: 9367 - RNA, 1623 nt, Artificial Sequence; identical to SEQ ID NO: 9305
  derived and/or modified sequence opt1 from VP1__Norovirus__AFJ21393

SEQ ID NO: 9368 - RNA, 1623 nt, Artificial Sequence; identical to SEQ ID NO: 9292
  derived and/or modified sequence opt1 from VP1__Norovirus__AFJ21394

SEQ ID NO: 9369 - RNA, 1623 nt, Artificial Sequence; identical to SEQ ID NO: 9305
  derived and/or modified sequence opt1 from VP1__Norovirus__AFJ21395

SEQ ID NO: 9370 - RNA, 1623 nt, Artificial Sequence; identical to SEQ ID NO: 9292
  derived and/or modified sequence opt1 from VP1__Norovirus__AFJ21396

SEQ ID NO: 9371 - RNA, 1623 nt, Artificial Sequence
  derived and/or modified sequence opt1 from VP1__Norovirus__AFJ21397
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggaccccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccggggcgacgugacccacaucgccgggacccaggaguacaccaugaaccuggccucccagaacuggaacaacuacgacccgacggaggagauccccgcgccccugggcacccccgacuucguggggaagauccagggcguccucacccagaccacgcgcggggacggcagcacccgggggcacaaggccaccgugagcaccggcuccgugcacuucacgccgaagcugggccgcauccaguucagcaccgacaccuccaacgacuucgagaccgggcagaacacgcgguucacccccgucggcguggugcaggacgggagcaccacccaccagaacgagccccagcaguggguccugcccaacuacuccggccgcgacagccacaacgugcaccucgccccggccguggcccccuccuuccccggggagcagcugcuguucuuccggagcacgaugcccggcugcuccggcuacccgaacaugaaccucgacugccugcugccccaggaguggguccagcacuucuaccaggaggccgcgcccgcccagagcgacguggcccuccugcgcuucgugaaccccgacaccgggcggguccuguucgagugcaagcuccacaaguccggcuacgugaccguggcccacaccgggcagcacgaccuggucaucccgcccaacggcuacuuccgcuucgacagcugggugaaccaguucuacacccuggcgcccauggggaacggcacgggccggcgccgcgcccucuga

SEQ ID NO: 9372 - RNA, 1623 nt, Artificial Sequence
  derived and/or modified sequence opt1 from VP1__Norovirus__AFJ21398
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucauccccagcaacggguacuuccgguucgacuccugggugaaccaguucuacacccucgcccccaugggcaacggcacggggcgccggcgcgcccuguga

SEQ ID NO: 9373 - RNA, 1623 nt, Artificial Sequence
  derived and/or modified sequence opt1 from VP1__Norovirus__AFJ21399
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccgcgcugaacuggaacaacuacgaccccaccgaggagaucccggcgccccucggcacgcccgacuucguggggaagauccagggcguccugacccagaccaccaaggccgacgggagcacgcggggccacaaggccaccguguacaccggcuccgccgacuucacccccaagcuggggagcgugcaguucagcacggacaccgagaacgacuucgagacccaccagaacaccaaguucacgccggucggcgugauccaggacgggaacaccacccaccgcaacgagccccagcagugggugcuccccuccuacagcggccggaacguccacaacgugcaccuggcccccgccguggccccgaccuuccccggggagcagcuccucuucuuccgcuccacgaugcccggcugcagcggcuaccccaacauggaccuggacugccugcucccgcaggaguggguccagcacuucuaccaggaggccgcgcccgcccaguccgacguggcccugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcgcgcuguga

SEQ ID NO: 9374 - RNA, 1623 nt, Artificial Sequence; identical to SEQ ID NO: 9372
  derived and/or modified sequence opt1 from VP1__Norovirus__AFJ21400

SEQ ID NO: 9375 - RNA, 1623 nt, Artificial Sequence
  derived and/or modified sequence opt1 from VP1__Norovirus__AFJ21401
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcgacuacaccaugaaccuggccagccugaacuggaacaacuacgaccccaccgaggagacgccggcgccccucggcacccccgacuucguggggaagauccagggcaugcugacccagaccacgaagggggacggcuccacccggggccacaaggccaccgucuacaccgggagcgcccccuucacgccgaagcugggcagcgugcgcuucuccaccgacaccgagaacgacuucgagacccaccagaacacgaaguucacccccgugggggucauccaggacggcagcaccacccaccggaacgagccccagcagugggugcuccccuccuacagcgggcgcgacgugcacaacguccaccuggccccggccguggcgcccacguuccccggcgagcagcuccucuucuuccgguccaccaugcccggcugcagcggguacccgaacauggaccuggacugccugcucccccaggagugggugcagcacuucuaccaggaggccgcccccgcccaguccgacgucgcgcugcugcgcuucgugaaccccgacaccggccggguccucuucgagugcaagcugcacaagagcggguacgugaccguggcccacaccggccagcacgaccuggugaucccgcccaacggguacuuccgcuucgacuccugggucaaccaguucuacacgcucgcccccaugggcaacggcaccgggcggcgccgcgcccuguga

SEQ ID NO: 9376 - RNA, 1623 nt, Artificial Sequence
  derived and/or modified sequence opt1 from VP1__Norovirus__AFJ21402
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcgacuacaccaugaaccuggccagccugaacuggaacaacuacgaccccaccgaggagaucccggcgccccucggcacgcccgacuucguggggaagauccagggcaugcugacccagaccaccaagggggacggcuccacgcggggccacaaggccaccgucuacaccgggagcgcccccuucaccccgaagcugggcagcgugcgcuucuccacggacaccgagaacgacuucgagacccaccagaacaccaaguucacgcccgugggggucauccaggacggcagcaccacccaccggaacgagccccagcagugggugcuccccuccuacagcgggcgcgacgugcacaacguccaccuggccccggccguggcgcccaccuuccccggcgagcagcuccucuucuuccgguccacgaugcccggcugcagcggguacccgaacauggaccuggacugccugcucccccaggagugggugcagcacuucuaccaggaggccgcccccgcccaguccgacgucgcgcugcugcgcuucgugaaccccgacaccggccggguccucuucgagugcaagcugcacaagagcggguacgugaccguggcccacaccggccagcacgaccuggugaucccgcccaacggguacuuccgcuucgacuccugggucaaccaguucuacacccucgcccccaugggcaacggcacggggcggcgccgcgcccuguga

SEQ ID NO: 9377 - RNA, 1623 nt, Artificial Sequence; identical to SEQ ID NO: 9376
  derived and/or modified sequence opt1 from VP1__Norovirus__AFJ21403

SEQ ID NO: 9378 - RNA, 1623 nt, Artificial Sequence; identical to SEQ ID NO: 9376
  derived and/or modified sequence opt1 from VP1__Norovirus__AFJ21404

SEQ ID NO: 9379 - RNA, 1623 nt, Artificial Sequence
  derived and/or modified sequence opt1 from VP1__Norovirus__AFJ21405
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucuccacggacaccgagaacgacuucgagacccaccagaacaccaaguucacgccggucggcgugauccaggacgggagcaccacccaccgcaacgagccccagcagugggugcuccccuccuacagcggccggaacguccacaacgugcaccuggcccccgccguggcgccgaacuuccccggggagcagcuccucuucuuccgcuccaccaugcccggcugcagcggcuaccccaacauggaccuggacugccugcucccgcaggaguggguccagcacuucuaccaggaggccgcccccgcccaguccgacguggcgcugcugcgguucgugaaccccgacacggggcgcguccucuucgagugcaagcugcacaagcccggcuacgugaccguggcccacaccgggcagcacgaccuggucaucccgcccaacggcuacuuccgguucgacagcugggugaaccaguucuacacccucgcccccauggggaacggcgccggccgccggcgcgcccuguga

SEQ ID NO: 9380 - RNA, 1623 nt, Artificial Sequence; identical to SEQ ID NO: 8882
  derived and/or modified sequence opt1 from VP1__Norovirus__AFJ21406

SEQ ID NO: 9381 - RNA, 1623 nt, Artificial Sequence
  derived and/or modified sequence opt1 from VP1__Norovirus__AFJ21407
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggguccgcaacaacuucgugcaggcccccgggggcgaguucaccgugagcccccggaacgcccccggggagauccugugguccgcgccccugggcccggaccucaaccccuaccugagccaccuggcccgcauguacaacggcuacgccgggggcuucgagguccaggugauccucgccgggaacgccuucacggcgggcaagaucaucuucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccauccugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucgccggcagccacaacuacaccaugaaccuggccucccagaacuggaacagcuacgacccgaccgaggagauccccgcgccccuggggacgcccgacuucgucggcaagauccagggggugcucacccagaccacccgcacggacggcagcacccgggggcacaaggccaccguguacaccggcuccacggaguucagcccgaagcugggccgcguccaguucgccaccgacaccaacaacgacuucgacgccaaccagaacaccaaguucacgcccgugggggugauccaggacggcgggaccacccaccggaacgagccccagcaguggguccugcccuccuacagcggccgcaacacccacaacgugcaccucgccccggccguggcgcccacguuccccggggagcagcugcuguucuuccgguccaccaugcccggcugcagcggcuacccgaacauggaccucgacugccugcugccccaggaguggguccaguacuucuaccaggaggccgcccccgcccaguccgacguggcgcuccugcgcuucgugaaccccgacaccgggcggguccuguucgagugcaagcuccacaagagcggcuacgugaccguggcccacaccgggcagcacgaccuggucaucccgcccaacggcuacuuccgcuucgacuccugggugaaccaguucuacacgcuggcccccauggggaacggcaccggccggcgccgcgcccucuga

SEQ ID NO: 9382 - RNA, 1623 nt, Artificial Sequence
  derived and/or modified sequence opt1 from VP1__Norovirus__AFJ21409
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcgacaccgcgcaccgcaacgagccccagcagugggugcugcccuccuacagcgggcggaacucccacaacguccaccucgccccggccguggcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacgucgcccuccugcgguucgugaaccccgacacgggccgcgugcuguucgagugcaagcuccacaaguccggguacgucaccguggcccacaccggccagcacgaccuggugaucccgcccaacggguacuuccgguucgacagcugggucaaccaguucuacacccuggcgcccaugggcaacgggaccggccgccgccgggcccucuga

SEQ ID NO: 9383 - RNA, 1623 nt, Artificial Sequence
  derived and/or modified sequence opt1 from VP1__Norovirus__AFJ21410
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucguguucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccauccugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucgccggcagccacaacuacaccaugaaccuggccucccagaacuggaacagcuacgacccgaccgaggagauccccgcgccccuggggacgcccgacuucgucggcaagauccagggggugcucacccagaccacccgcacggacggcagcacccgggggcacaaggccaccguguacaccggcuccgccgaguucagcccgaagcugggccgcguccaguucgccacggacaccaacaacgacuucgacgccaaccagaacaccaaguucacccccgugggggugauccaggacggcgggacgacccaccggaacgagccccagcaguggguccugcccuccuacagcggccgcaacacccacaacgugcaccucgccccggcgguggcccccaccuuccccggggagcagcugcuguucuuccgguccacgaugcccggcugcagcggcuacccgaacauggaccucgacugccugcugccccaggaguggguccaguacuucuaccaggaggccgcccccgcgcaguccgacguggcccuccugcgcuucgugaaccccgacaccgggcggguccuguucgagugcaagcuccacaagagcggcuacgugaccguggcccacaccgggcagcacgaccuggucaucccgcccaacggcuacuuccgcuucgacuccugggugaaccaguucuacacccuggcccccauggggaacggcacgggccggcgccgcgcccucuga

SEQ ID NO: 9384 - RNA, 1623 nt, Artificial Sequence; identical to SEQ ID NO: 9383
  derived and/or modified sequence opt1 from VP1__Norovirus__AFJ21411

SEQ ID NO: 9385 - RNA, 1623 nt, Artificial Sequence; identical to SEQ ID NO: 9383
  derived and/or modified sequence opt1 from VP1__Norovirus__AFJ21413

SEQ ID NO: 9386 - RNA, 1623 nt, Artificial Sequence; identical to SEQ ID NO: 8882
  derived and/or modified sequence opt1 from VP1__Norovirus__AFJ21414

SEQ ID NO: 9387 - RNA, 1623 nt, Artificial Sequence; identical to SEQ ID NO: 9383
  derived and/or modified sequence opt1 from VP1__Norovirus__AFJ21415

SEQ ID NO: 9388 - RNA, 1623 nt, Artificial Sequence; identical to SEQ ID NO: 8882
  derived and/or modified sequence opt1 from VP1__Norovirus__AFJ21416

SEQ ID NO: 9389 - RNA, 1623 nt, Artificial Sequence; identical to SEQ ID NO: 9383
  derived and/or modified sequence opt1 from VP1__Norovirus__AFJ21417

SEQ ID NO: 9390 - RNA, 1623 nt, Artificial Sequence
  derived and/or modified sequence opt1 from VP1__Norovirus__AFJ21418
augaagauggccagcuccgacgccaaccccagcgacggcuccaccgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugggcccggaccucaaccccuaccugagccaccuggcccgcauguacaacggcuacgccgggggcuucgagguccaggugauccucgccgggaacgccuucacggcgggcaagaucguguucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcagccacaacuacaccaugaaccuggccucccagaacuggaacagcuacgacccgaccgaggagauccccgcgccccuggggacgcccgacuucgugggcaagauccaggggguccucacccagaccacccgcacggacggcagcacccgggggcacaaggccaccguguacaccggcuccgccgaguucagcccgaagcugggccgcauccaguucgccacggacaccaacaacgacuucgacgccaaccagaacaccaaguucacccccgugggggucauccaggacggcgggacgacccaccggaacgagccccagcagugggugcugcccuccuacagcggccgcaacacccacaacgugcaccucgccccggcggucgcccccaccuuccccggggagcagcugcuguucuuccgguccacgcuccccggcugcagcggcuacccgaacauggaccuggacugccugcucccccaggagugggugcaguacuucuaccaggaggccgcccccgcgcaguccgacguggcccugcugcgcuucgucaaccccgacaccgggcggguccucuucgagugcaagcugcacaagagcggcuacgugaccguggcccacaccgggcagcacgaccuggugaucccgcccaacggcuacuuccgcuucgacuccugggugaaccaguucuacacccucgcccccauggggaacggcacgggccggcgccgcgcccuguga

SEQ ID NO: 9391 - RNA, 1623 nt, Artificial Sequence
  derived and/or modified sequence opt1 from VP1__Norovirus__AFJ21419
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcacguucgugguccagccccagaacgggcgcugcaccaccgacggcgugcuccuggggaccacgcagcucucccccgucaacaucugcaccuuccggggcgacgugacccacaucgccggcagccacaacuacaccaugaaccuggccucccagaacuggaacagcuacgacccgacggaggagauccccgcgccccuggggacccccgacuucgugggcaagauccaggggguccucacccagaccacgcgcaccgacggcagcacccgggggcacaaggccaccguguacacgggcuccgccgaguucagcccgaagcugggccgcgugcaguucgccaccgacaccaacaacgacuucgacgccaaccagaacaccaaguucacgcccgucggggugauccaggacggcgggaccacccaccggaacgagccccagcagugggugcugcccuccuacagcggccgcaacacccacaacguccaccucgccccggccguggcgcccacguuccccggggagcagcugcuguucuuccgguccaccaugcccggcugcagcggcuacccgaacauggaccucgacugccugaucccccaggagugggugcaguacuucuaccaggaggccgcccccgcccaguccgacgucgcgcugcuccgcuucgugaaccccgacaccgggcgggugcuguucgagugcaagcugcacaagagcggcuacgucaccguggcccacaccgggcagcacgaccucgugaucccgcccaacggcuacuuccgcuucgacuccugggucaaccaguucuacacgcuggcccccauggggaacggcaccggccggcgccgcgcccuguga

SEQ ID NO: 9392 - RNA, 1623 nt, Artificial Sequence; identical to SEQ ID NO: 9383
  derived and/or modified sequence opt1 from VP1__Norovirus__AFJ21420

SEQ ID NO: 9393 - RNA, 1623 nt, Artificial Sequence
  derived and/or modified sequence opt1 from VP1__Norovirus__AFJ21421
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucguguucgccguggucccgcccaacuucccgaccgaggggcugucccccagccaggugaccauguucccccacaucaucguggacguccggcagcuggagcccgugcucaucccgcugcccgacgugcgcaacaacuucuaccacuacaaccaguccaacgaccccaccaucaagcugaucgccaugcucuacacgccccugcgggccaacaacgccggcgacgacgucuucaccgugagcugccgcgugcugacccggccgucccccgacuucgacuucaucuuccucgucccgcccaccguggagagccgcacgaagcccuucuccgugcccauccugaccgucgaggagaugaccaacagccgguuccccaucccccuggagaagcuguucaccggcccguccagcgcguucgugguccagccccagaacgggcgcugcacgaccgacggcgugcuccuggggaccacccagcucucccccgugaacaucugcacguuccggggcgacgucacccacaucgccggcagccacaacuacaccaugaaccuggccucccagaacuggaacagcuacgacccgaccgaggagauccccgcgccccuggggacgcccgacuucgugggcaagauccagggggugcucacccagaccacccgcacggacggcagcacccgggggcacaaggccaccgucuacaccggcuccgccgaguucagcccgaagcugggccgcgugcaguucgccacggacaccaacaacgacuucgacgccaaccagaacaccaaguucacccccgugggggucauccaggacggcgggacgacccaccggaacgagccccagcagugggugcugcccuccuacagcggccgcaacacccacaacgugcaccucgccccggccgucgcgcccaccuuccccggggagcagcugcuguucuuccgguccacgaugcccggcugcagcggcuacccgaacauggaccucgacugccugcugccccaggagugggugcaguacuucuaccaggaggccgcccccgcccaguccgacguggcgcuccugcgcuucgucaaccccgacaccgggcgggugcuguucgagugcaagcuccacaagagcggcuacgugaccgucgcccacaucgggcagcacgaccuggugaucccgcccaacggcuacuuccgcuucgacuccugggugaaccaguucuacacccuggcccccauggggaacggcaccggccggcgccgcgcccucuga

SEQ ID NO: 9394 - RNA, 1623 nt, Artificial Sequence; identical to SEQ ID NO: 9383
  derived and/or modified sequence opt1 from VP1__Norovirus__AFJ21422

SEQ ID NO: 9395 - RNA, 1623 nt, Artificial Sequence; identical to SEQ ID NO: 8878
  derived and/or modified sequence opt1 from VP1__Norovirus__AFJ21423

SEQ ID NO: 9396 - RNA, 1623 nt, Artificial Sequence; identical to SEQ ID NO: 8882
  derived and/or modified sequence opt1 from VP1__Norovirus__AFJ21424

SEQ ID NO: 9397 - RNA, 1623 nt, Artificial Sequence
  derived and/or modified sequence opt1 from VP1__Norovirus__AFJ21425
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacaacuacgaccccaccgaggagauccccgcgccccuggggacgccggacuucgucggcaagauccagggggugcucacccagaccacccggacgaacggcagcacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccugcccuccuacagcgggcggaacauccacaacgugcaccucgcccccgccguggcccccaccuucccgggcgagcagcugcuguucuuccgcuccaccaugcccgggugcagcggcuaccccaacauggaccucgacugccugcugccccaggaguggguccaguacuucuaccaggaggcggccccggcccaguccgacguggcccuccugcgguucgugaaccccgacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgggcccucuga

SEQ ID NO: 9398 - RNA, 1623 nt, Artificial Sequence; identical to SEQ ID NO: 8882
  derived and/or modified sequence opt1 from VP1__Norovirus__AFJ21426

SEQ ID NO: 9399 - RNA, 1623 nt, Artificial Sequence
  derived and/or modified sequence opt1 from VP1__Norovirus__AFJ21428
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgaccccgccgaggagaucccggcgccccuggggacccccgacuucgucggcaagauccagggggugcucacgcagaccacccggaccaacggcagcacgcgcgggcacaaggccaccguguacaccggcuccgccgacuucagccccaagcugggccggguccaguucgccaccgacacggacaacgacuucgagaccaaccagaacaccaaguucaccccggugggggugauccaggacggcuccacgacgccccgcaacgagccccagcaguggguccugcccagcuacuccgggcggaacauccacaacgugcaccucgccccggccguggcgcccaccuuccccggcgagcagcugcuguucuuccgcagcaccaugcccgggugcuccggcuacccgaacauggaccucgacugccugcugccccaggaguggguccaguacuucuaccaggaggccgcccccgcccagagcgacguggcgcuccugcgguucgugaaccccgacaccggccgcguccuguucgagugcaagcuccacaaguccggguacgugaccguggcccacaccggccagcacgaccuggucaucccgcccaacggguacuuccgguucgacagcugggugaaccaguucuacacccuggcccccaugggcaacgggaccggccgccgccgggcccucuga

SEQ ID NO: 9400 - RNA, 1623 nt, Artificial Sequence; identical to SEQ ID NO: 8882
  derived and/or modified sequence opt1 from VP1__Norovirus__AFJ21429

SEQ ID NO: 9401 - RNA, 1623 nt, Artificial Sequence; identical to SEQ ID NO: 8882
  derived and/or modified sequence opt1 from VP1__Norovirus__AFJ21430

SEQ ID NO: 9402 - RNA, 1623 nt, Artificial Sequence; identical to SEQ ID NO: 8882
  derived and/or modified sequence opt1 from VP1__Norovirus__AFJ21431

SEQ ID NO: 9403 - RNA, 1623 nt, Artificial Sequence
  derived and/or modified sequence opt1 from VP1__Norovirus__AFJ21432
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaccccgggcagccacaacuacaccaugaaccuggccucccagaacuggaacagcuacgaccccacggaggagauccccgcgccccuggggaccccggacuucgucggcaagauccagggggugcucacccagaccacgcgcaccaacggcagcacccgggggcacaaggccaccguguacacgggcuccgccgacuucagccccaagcugggccgcguccaguucgccaccgacaccgacaacgacuucgagaccaaccagaacacgaaguucacccccgugggggugauccaggacggcuccaccacgccccggaacgagccgcagcaguggguccugcccagcuacuccgggcgcaacauccacaacgugcaccucgcccccgccguggcccccaccuucccgggcgagcagcugcuguucuuccggagcaccaugcccgggugcuccggcuaccccaacauggaccucgacugccugcugccccaggaguggguccaguacuucuaccaggaggcggccccggcccagagcgacguggcccuccugcgcuucgugaaccccgacaccggccggguccuguucgagugcaagcuccacaaguccggguacgugaccguggcgcacaccggccagcacgaccuggucaucccgcccaacggguacuuccgcuucgacagcugggugaaccaguucuacacgcuggcccccaugggcaacgggaccggccggcgccgcgcccucuga

SEQ ID NO: 9404 - RNA, 1623 nt, Artificial Sequence
  derived and/or modified sequence opt1 from VP1__Norovirus__AFJ21433
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccgugcaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgggcccucuga

SEQ ID NO: 9405 - RNA, 1623 nt, Artificial Sequence
  derived and/or modified sequence opt1 from VP1__Norovirus__AFJ21434
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgaccccaccgaggagaucccggcgccccuggggacgcccgacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgccggugggggugauccaggacggcuccaccacgccccgcaacgagccccagcaguggguccugcccagcuacuccgggcggaacauccacaacgugcaccucgccccggccguggcccccaccuuccccggcgagcagcugcuguucuuccgcagcaccaugcccgggugcuccggcuacccgaacauggaccucgacugccugcugccccaggaguggguccaguacuucuaccaggaggcggcccccgcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgggcccucuga

SEQ ID NO: 9406 - RNA, 1623 nt, Artificial Sequence; identical to SEQ ID NO: 8882
  derived and/or modified sequence opt1 from VP1__Norovirus__AFJ21436

SEQ ID NO: 9407 - RNA, 1623 nt, Artificial Sequence; identical to SEQ ID NO: 9405
  derived and/or modified sequence opt1 from VP1__Norovirus__AFJ21437

SEQ ID NO: 9408 - RNA, 1623 nt, Artificial Sequence
  derived and/or modified sequence opt1 from VP1__Norovirus__AFJ21438
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaucggccaguacgaccuggucaucccgcccaacggguacuuccgguucgacagcugggugaaccaguucuacacccuggcccccaugggcaacgggaccggccgccgccgggcccucuga

SEQ ID NO: 9409 - RNA, 1623 nt, Artificial Sequence; identical to SEQ ID NO: 8878
  derived and/or modified sequence opt1 from VP1__Norovirus__AFJ21439

SEQ ID NO: 9410 - RNA, 1623 nt, Artificial Sequence
  derived and/or modified sequence opt1 from VP1__Norovirus__AFJ21440
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccgggccaacggcagcacgcgcgggcacaaggccaccguguacaccggcuccgccgacuucagccccaagcugggccggguccaguucgccaccgacacggacaacgacuucgagaccaaccagaacaccaaguucacccccgugggggugauccaggacggcuccacgacgccccgcaacgagccgcagcaguggguccugcccagcuacuccgggcggaacauccacaacgugcaccucgcccccgccguggcgcccaccuucccgggcgagcagcugcuguucuuccgcagcaccaugcccgggugcuccggcuaccccaacauggaccucgacugccugcugccccaggaguggguccaguacuucuaccaggaggccgccccggcccagagcgacguggcgcuccugcgguucgugaaccccgacaccggccgcguccuguucgagugcaagcuccacaaguccggguacgugaccguggcccacaccggccagcacgaccuggucaucccgcccaacggguacuuccgguucgacagcugggugaaccaguucuacacccuggcccccaugggcaacgggaccggccgccgccgggcccucuga

SEQ ID NO: 9411 - RNA, 1623 nt, Artificial Sequence
  derived and/or modified sequence opt1 from VP1__Norovirus__AFJ21441
augaagauggccagcuccgacgccaaccccagcgacggcuccaccgcgaaccuggugccggaggucaacaccgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucaccgcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcaccaagcccuucuccguccccgugcugaccguggaggagaugaccaacagccgguuccccaucccccuggagaagcuguucacgggcccguccagcgccuucgucgugcagccccagaacgggcgcugcaccaccgacggcguccuccuggggaccacgcagcucucccccgugaacaucugcaccuuccggggcgacgugacccacaucccgggcagccgcaacuacaccaugaaccuggccucccagaacuggaacagcuacgaccccacggaggagauccccgcgccccuggggaccccggacuucgucggcaagauccagggggugcucacccagaccacgcggaccaacggcagcacccgcgggcacaaggccaccguguacacgggcuccgccgacuucagccccaagcugggccggguccaguucgccaccgacaccgacaacgacuucgagaccaaccagaacacgaaguucacccccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacgccgcgcuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacgcuggcccccaugggcaacgggaccggccgccgccgggcccucuga

SEQ ID NO: 9412 - RNA, 1623 nt, Artificial Sequence
  derived and/or modified sequence opt1 from VP1__Norovirus__AFJ21442
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaaguccuucacgguccccauccugaccguggaggagaugaccaacagccgguuccccaucccccuggagaagcuguucaccggccccuccagcgccuucgugguccagccccagaacgggcgcugcacgaccgacggcgugcugcuggggaccacccagcucuccccggucaacaucugcacguuccggggcgacgugacccacaucgccggcagccgcaacuacaccaugaaccuggccucccugaacuggaacaacuacgaccccaccgaggagauccccgcgccgcucgggacgcccgacuucgugggcaagauccaggggguccugacccagaccaccaagggcgacgggagcacgcggggccacaaggccaccguguacaccggcagcgccgacuucacccccaagcugggguccgugcaguucggcacggacaccgacaacgacuucgagacccaccagaacaccaaguucacgcccgucggggugauccaggacggcagcaccacccaccgcaacgagccgcagcagugggugcuccccuccuacagcgggcggaacguccacaacgugcaccuggcccccgccguggcgcccaacuucccgggcgagcagcuccucuucuuccgcuccaccaugcccggcugcagcggguaccccaacauggaccuggacugccugcucccccaggaguggguccagcacuucuaccaggaggccgccccggcccaguccgacguggcgcugcugcgguucgugaaccccgacacgggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcgccgggcgcaagcgggcccuguga

SEQ ID NO: 9413 - RNA, 1623 nt, Artificial Sequence
  derived and/or modified sequence opt1 from VP1__Norovirus__AFJ21443
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaugaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaccccgggcagccacaacuacaccaugaaccuggccucccagaacuggaacagcuacgaccccacggaggagauccccgcgccccuggggaccccggacuucgucggcaagauccagggggugcucacccagaccacgcgcaccaacggcagcacccgggggcacaaggccaccguguacacgggcuccgccgacuucagccccaagcugggccgcguccaguucgccaccgacaccgacaacgacuucgagaccaaccagaacacgaaguucacccccgugggggugauccaggacggcuccaccacgccccggaacgagccgcagcaguggguccugcccagcuacuccgggcgcaacauccacaacgugcaccucgcccccgccguggcccccaccuucccgggcgagcagcugcuguucuuccggagcaccaugcccgggugcuccggcuaccccaacauggaccucgacugccugcugccccaggaguggguccaguacuucuaccaggaggcggccccggcccagagcgacguggcccuccugcgcuucgugaaccccgacaccggccggguccuguucgagugcaagcuccacaaguccggguacgugaccguggcgcacaccggccagcacgaccuggucaucccgcccaacggguacuuccgcuucgacagcugggugaaccaguucuacacgcuggcccccaugggcaacgggaccggccggcgccgcgcccucuga

SEQ ID NO: 9414 - RNA, 1623 nt, Artificial Sequence
  derived and/or modified sequence opt1 from VP1__Norovirus__AFJ21444
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaccgccggcagccacaacuacaccaugaaccuggccucccagaacuggaacagcuacgacccgacggaggagauccccgcgccccuggggacccccgacuucgugggcaagauccaggggguccucacccagaccacgcgcgccgacggcagcacccgggggcacaaggccaccguguacaccggcuccgccgaguucagcccgaagcugggccgcgugcaguucgccacggacaccgacaacgacuucgacgccaaccagaacaccaaguucacccccgucggggugauccaggacggcgggacgacccaccggaacgagccccagcagugggugcugcccuccuacagcggccgcaacacccacaacguccaccucgcgccggccguggcccccaccuuccccggggagcagcugcuguucuuccgguccacgaugcccggcugcagcggcuacccgaacauggaccucgacugccugcugccccaggagugggugcaguacuucuaccaggaggccgcgcccgcccaguccgacgucgcccuccugcgcuucgugaaccccgacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccggcgccgcgcgcucuga

SEQ ID NO: 9415 - RNA, 1623 nt, Artificial Sequence; identical to SEQ ID NO: 8882
  derived and/or modified sequence opt1 from VP1__Norovirus__AFJ21445

SEQ ID NO: 9416 - RNA, 1623 nt, Artificial Sequence
  derived and/or modified sequence opt1 from VP1__Norovirus__AFJ21446
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccgucccccuggagaagcuguucaccggcccguccagcgccuucgugguccagccccagaacgggcgcugcacgaccgacggcgugcuccuggggaccacccagcucucccccgugaacaucugcacguuccggggcgacgucacccacaucccgggcagccgcaacuacaccaugaaccuggccucccagaacuggaacagcuacgaccccaccgaggagauccccgcgccccuggggacgccggacuucgugggcaagauccagggggugcucacccagaccacccggacgaacggcagcacccgcgggcacaaggccaccgucuacaccggcuccgccgacuucagccccaagcugggccgggugcaguucgccacggacaccgacaacgacuucgagaccaaccagaacaccaaguucacgcccgugggggucauccaggacggcuccaccacgccccgcaacgagccgcagcagugggugcugcccagcuacuccgggcggaacauccacaacgugcaccucgcccccgccgucgcccccaccuucccgggcgagcagcugcuguucuuccgcagcaccaugcccgggugcuccggcuaccccaacauggaccucgacugccugcugccccaggagugggugcaguacuucuaccaggaggcggccccggcccagagcgacguggcccuccugcgguucgucaaccccgacaccggccgcgugcuguucgagugcaagcuccacaaguccggguacgugaccgucgcgcacaccggccagcacgaccuggugaucccgcccaacggguacuuccgguucgacagcugggugaaccaguucuacacccuggcccccaugggcaacgggacgggccgccgccgggcccucuga

SEQ ID NO: 9417 - RNA, 1623 nt, Artificial Sequence; identical to SEQ ID NO: 8882
  derived and/or modified sequence opt1 from VP1__Norovirus__AFJ21448

SEQ ID NO: 9418 - RNA, 1623 nt, Artificial Sequence
  derived and/or modified sequence opt1 from VP1__Norovirus__AFJ21451
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagacccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccgcaacuacaccaugaaccuggccagccugaacuggaacaacuacgaccccacggaggagaucccggcgccccucgggacccccgacuucgugggcaagauccaggggaugcugacccagaccacgcagggcgacggguccacccggggccacaaggccaccgucuacaccggcagcgccgacuucacgcccaagcuggggagcgugcaguucgccaccgacaccgagaacgacuucgagacccaccagaacacgaaguucaccccggugggcgucauccaggacggguccaccacccaccgcaacgagccccagcagugggcccuccccagcuacuccggccggagcgcgcacaacgugcaccuggcccccgccguggccccgaacuuccccggggagcagcuccucuucuuccgcuccacgaugcccggcugcagcggcuaccccaacauggaccuggacugccugcucccgcaggaguggguccagcacuucuaccaggaggcggcccccgcccaguccgacguggcccugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcgcccauggggaacggcacgggccgccggcgcgcccuguga

SEQ ID NO: 9419 - RNA, 1623 nt, Artificial Sequence
  derived and/or modified sequence opt1 from VP1__Norovirus__AFJ21454
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgagcucccgcaacuacaccaugaaccuggccagccagaacuggaacagcuacgaccccaccgaggagauccccgcgccccugggcacgccggacuucgucgggaagauccagggcgugcucacccagaccacccggacggacggguccacccgcggccacaaggccaccguguacaccgggagcgccgacuucucccccaagcugggccggguccaguucgccacggacaccgacaacgacuucgagaccaaccagaacaccaaguucacgcccgugggcgugauccaggacgggagcaccacccaccgcaacgagccccagcaguggguccugccguccuacagcggccggaacauccacaacgugcaccucgcccccgccguggcccccaccuuccccggggagcagcugcuguucuuccgcuccacgaugccgggcugcagcggguaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggcuacgugaccguggcgcacaccgggcagcacgaccuggucaucccgcccaacggcuacuuccgguucgacuccugggugaaccaguucuacacccuggcccccauggggaacggcacggggcgccgccgggcccucuga

SEQ ID NO: 9420 - RNA, 1623 nt, Artificial Sequence
  derived and/or modified sequence opt1 from VP1__Norovirus__AFL70023
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccuggcccaccuggcccgcauguacaacggcuacgccgggggcuucgaggugcaggucauccucgccgggaacgcguucacggccggcaagaucaucuucgccgccgugccgcccaacuucccgaccgaggggcugucccccagccaggugaccauguucccccacaucgucguggacgugcggcagcuggagcccguccucaucccgcugcccgacgugggcaacaacuucuaccacuacaaccaguccaacgaccccaccaucaagcugaucgccaugcucuacacgccccugcgcgcgaacaacgccggcgaggacguguucaccgucagcugccgggugcugacccgcccgucccccgacuucgacuucaucuuccucgugccgcccaccgucgagagccggacgaagcccuucaccgugcccauccugaccguggaggagaugaccaacucccgcuuccccaucccccuggagaagcuguucacggggccgagcggcgccuucgucgugcagccccagaacgggcggugcaccaccgacggcguccuccugggcaccacgcagcucucccccgugaacaucugcaccuuccgcggggacgugacccacaucgccggcacccacaacuacacgaugaaccuggccagccagaacuggaacaacuacgacccgaccgaggagauccccgcgccccuggggacccccgacuucgucggccggauccaggggaugcucacccagacgacccgcggcgacggcuccacccgggggcacaaggccaccgugagcacgggcgacgugcacuucaccccgaagcugggguccauccaguucaacaccgacaccaacaacgacuucgagacgggccagaacaccaaguucacccccgucgggguggugcaggacggcaacggcgcccaccagaacgagccccagcaguggguccugcccagcuacuccgggcgcaccggccacaacgugcaccucgccccggccguggcgcccacguuccccggggagcagcugcuguucuuccggagcaccaugcccggcugcagcggguacccgaacaugaaccucgacugccugcugccccaggaguggguccagcacuucuaccaggaggccgcccccgcccaguccgacguggcgcuccugcgcuucgugaaccccgacaccggccggguccuguucgagugcaagcuccacaagagcggcuacgugaccguggcccacaccgggcagcacgaccuggucaucccgcccaacggcuacuuccgcuucgacuccugggugaaccaguucuacacgcuggcccccauggggaacggcaccggccggcgccgggcccucuga

SEQ ID NO: 9421 - RNA, 1653 nt, Artificial Sequence
  derived and/or modified sequence opt1 from VP1__Norovirus__AFN06724
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagagcaccccgcgcaugcggcugaucgccaugcuguacacgccccuccgcgccaacuccggcgaggacguguucaccgugagcugccggguccugacccgccccgcgcccgacuucgaguucaccuuccuggugccgcccaccguggaguccaagaccaagcccuucacgcuccccauccugacccugggggagcucagcaacucccgguucccggccgccaucgacaugcuguacaccgaccccaacgagagcaucgucgugcagccccagaacggccgcugcacccuggacggcacgcuccaggggaccacccagcuggugcccacccagaucugcgccuuccggggcacgcugaucucccagaccgcccgcgcggccgacagcaccgacuccccgcagcgggcccgcgaccacccccuccacguccaggugaagaaccuggacgggacccaguacgaccccacggacgacaucccggccguccugggcgccaucgacuucaagggcaccguguucgggguggcgagccagcgggacgucuccggccagcaggagcaggggcacuacgccacccgcgcccacgaggcccacaucgacaccacggaccccaaguacgcgcccaagcucggcaccauccugaucaagagcgagagcaacgacuucaccaccaaccagcccauccgguucacgccgguggggaugggcgacaacaacuggcgccagugggagcugcccgacuacuccggccggcucacccugaacaugaaccuggcccccgccgugagccccuccuucccgggggagcgcauccucuucuuccgcagcaucguccccuccgccggcggguucggcagcggguacaucgacugccugaucccccaggagugggugcagcacuucuaccaggaggccgcgcccucccagagcgccguggcccugguccgguacgugaacccggacaccggccgcaacaucuucgaggccaagcuccaccgggagggcuuccugaccguggccaacuccgggaacaaccccaucgucgugccgcccaacggcuacuuccgcuucgaggcgugggugaaccaguucuacacgcuggcccccauggggagcggccaggggcggcgccgggcccaguga

SEQ ID NO: 9422 - RNA, 1653 nt, Artificial Sequence
  derived and/or modified sequence opt1 from VP1__Norovirus__AFN06725
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugaucgccaugcuguacacgccccuccgcgccaacagcggcgaggacguguucaccguguccugccggguccugacccgccccgcgcccgacuucgaguucaccuuccuggugccgcccaccguggagagcaagaccaagcccuucacgcuccccauccugacccugggggagcucuccaacagccgguucccggccgccaucgacaugcuguacaccgaccccaacgaguccaucgucgugcagccccagaacggccgcugcacccuggacggcacgcuccaggggaccacccagcuggugcccacccagaucugcgccuuccggggcacgcugaucagccagaccgcccgcgcggccgacuccaccgacagcccgcagcgggcccgcgaccacccccuccacguccaggugaagaaccuggacgggacccaguacgaccccacggacgacaucccggccguccugggcgccaucgacuucaagggcaccguguucgggguggcgucccagcgggacgucagcggccagcaggagcaggggcacuacgccacccgcgcccacgaggcccacaucgacaccacggaccccaaguacgcgcccaagcucggcaccauccugaucaaguccgagagcaacgacuucaccaccaaccagcccauccgguucacgccgguggggaugggcgacaacaacuggcgccagugggagcugcccgacuacagcggccggcucacccugaacaugaaccuggcccccgccgugucccccagcuucccgggggagcgcauccucuucuuccgcuccaucguccccagcgccggcggguucggcuccggguacaucgacugccugaucccccaggagugggugcagcacuucuaccaggaggccgcgcccagccaguccgccguggcccugguccgguacgugaacccggacaccggccgcaacaucuucgaggccaagcuccaccgggagggcuuccugaccguggccaacagcgggaacaaccccaucgucgugccgcccaacggcuacuuccgcuucgaggcgugggugaaccaguucuacacgcuggcccccaugggguccggccaggggcggcgccgggcccaguga

SEQ ID NO: 9423 - RNA, 1629 nt, Artificial Sequence
  derived and/or modified sequence opt1 from VP1__Norovirus__AFN06726
augaagauggccagcaacgacgccgcgcccuccaccgacggcgccgccgggcuggugccggagagcaacuccgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucaaccuggagcugggccccgagcucaacccguaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccaggacaacgaccaccuguacaacaucaccaucaccaaccugaacgggucccccuucgacccgagcgaggacauccccgcgccccucggcgucccggacuuccaggggcggguguucggcgugaucacgcagcgcgacaagcagaacgcggccgggcagucccagcccgccaaccggggccacgacgccgucgugcccaccuacaccgcccaguacacccccaagcugggccaggugcagaucgggacguggcagaccgacgaccugaaggucaaccagccggugaaguucacccccgugggccucaacgacaccgagcacuucaaccagugggucgugccccgcuacgcgggggcccugaaccugaacacgaaccucgcccccagcguggccccggucuuccccggcgagcggcugcuguucuuccgcagcuaccucccccugaagggcggguacggcaaccccgcgaucgacugccugcucccgcaggagugggugcagcacuucuaccaggaggccgcccccuccaugagcgagguggcccugguccgguacaucaaccccgacaccgggcgcgcccuguucgaggcgaagcuccaccgggccggcuucaugaccguguccagcaacaccuccgcccccguggucgugccggccaacggguacuuccgcuucgacagcugggugaaccaguucuacucccuggcccccaugggcacggggaacggccggcgccgcauccaguga

SEQ ID NO: 9424 - RNA, 1617 nt, Artificial Sequence
  derived and/or modified sequence opt1 from VP1__Norovirus__AFN06727
augaagauggccagcaacgacgccacccccuccgacgacggcgcggccgggcuggugccggagaucaacaacgaggucauggcccucgagcccguggccggcgccagcaucgcggcccccguggucgggcagcagaacaucaucgaccccuggauccgcaacaacuucgugcaggccccggccggcgaguucaccgugagcccccggaacucccccggggagcugcugcucgaccuggagcugggccccgagcucaacccguaccuggcgcaccuggcccgcauguacaacggccacgccgggggcauggagguccagaucgugcucgccgggaacgccuucacggcgggcaagauccuguucgccgccaucccgcccuccuuccccuacgagaaccugagccccgcccagcucaccaugugcccccacgugaucgucgacgugcggcagcuggagcccgugcugcuccccaugccggacauccgcaacgucuucuaccacuacaaccagaacaacucccccaagcugcggcugguggccaugcucuacacgccccugcgcgcgaacaacagcggggacgacguguucaccgucuccugccgggugcugacccgccccagcccggacuuccaguucaccuuccucgugccgcccaccgucgaguccaagaccaagaacuucacgcugcccgugcugcgggugagcgagaugaccaacucccgcuuccccgucgugcucgaccagauguacaccagccggaacgagaacaucaucgugcagccccagaacggccgcugcaccacggacggcgagcugcuggggaccaccauccuccaguccgucagcaucugcaacuucaagggcaccaugcaggccgagcuguccgaccagccccgguaccaguaccagcugcagcucacgaaccuggacgggagccccaucgacccgaccgacgacgugcccgcgccccugggcaccccggacuuccaggccaugcucuacggcgucgccucccagcgcagcagccgggacaacgccacccgcgcccacgacgcccagaucgacacggccggggacaccuucgcccccaagaucggccaggugcgguucaaguccagcuccaacgacuucgaccugcacgaccccaccaaguucacccccaucggggugaacgucgacgaccagcacccguuccgccaguggagccugcccaacuacggcgggcaccucgcgcugaacaaccaccuggcccccgccgugacgccccucuucccgggcgagcagauccuguucuuccgguccuacauccccagcgccggcgggcacaccgacggcgcgauggacugccugcucccccaggaguggaucgagcacuucuaccaggaguccgcccccagccaguccgacaucgcccuggugcgcuucaucaacccggacaccgggcggguccuguucgaggccaagcuccacaagcagggcuuccugaccaucgccgcgagcggggaccaccccaucgugaugcccacgaacggcuacuuccgcuucgaggccugggugaaccccuucuacacccuggccccggucggcaccggguccggccgccggcgcauccaguga

SEQ ID NO: 9425 - RNA, 1647 nt, Artificial Sequence
  derived and/or modified sequence opt1 from VP1__Norovirus__AFN06728
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucacccuccccauccugacgaucagcgagauguccaacagccgguuccccgugccgaucgacucccugcacaccagccccaccgagaacaucgucgugcagugccagaacgggcgcgugacccucgacggcgagcugauggggacgacccagcugcuccccucccagaucugcgccuuccggggcacccugacccgcagcacgucccgggcgagcgaccaggccgacaccgccacgccccgccuguucaacuacuacuggcacauccagcucgacaaccugaacggcaccccguacgaccccgccgaggacauccccgccccgcuggggacccccgacuuccggggcaaggucuucgggguggcgagccagcgcaaccccgacuccaccacccgggcccacgaggccaagguggacaccacgagcggccgcuucacccccaagcucgggucccuggagaucagcaccgaguccgacgacuucgacccgaaccagcccacccgguucacgcccgucggcaucggcguggacaacgaggccgacuuccagcaguggagccugcccgacuacuccgggcaguucacccacaacaugaaccucgcgccggccgucgcccccaacuuccccggcgagcagcugcuguucuuccgcagccagcuccccuccagcgggggccgguccaacgggauccuggacugccuggugccgcaggagugggugcagcacuucuaccaggagagcgcccccgcccagacccaggucgcgcucgugcgcuacgugaaccccgacaccggccgcguccuguucgaggccaagcugcacaagcucggcuucaugacgaucgccaagaacggggacucccccaucaccgugccgcccaacggcuacuuccgguucgagagcugggugaaccccuucuacacccuggcccccauggggaccggcaacgggcgccggcgcauccaguga

SEQ ID NO: 9426 - RNA, 1647 nt, Artificial Sequence
  derived and/or modified sequence opt1 from VP1__Norovirus__AFN06729
augaagauggccagcaacgacgccgcgcccuccaacgacggcgccgccgggcuggugccggagaucaacaacgaggccauggcccucgagcccgucgugggcgcggccaucgccgcgccccugaccgggcagcagaacaucaucgaccccuggaucaugaacaacuucgugcaggccccgggcggggaguucaccgucagcccccgcaacucccccggcgaggugcugcucaaccuggagcugggccccgagaucaacccguaccucgcccaccuggcccggauguacaacggguacgccggcggguucgaggugcaggucgugcuggccggcaacgcguucacggccgggaaggugaucuucgccgccaucccgcccaacuuccccaucgacaaccucagcgccgcgcagaucaccaugugcccccacgucaucguggacgugcgccagcuggagcccaucaaccugcccaugcccgacguccggaacaacuucuuccacuacaaccagggcuccgacagccgccuccggcugaucgccaugcuguacaccccgcuccgcgccaacaacuccggcgacgacguguucaccgugagcugccggguccugacgcgccccucccccgacuucagcuucaacuuccuggugcccccgaccguggaguccaagaucaagcccuucacccuccccauccugaccaucagcgagauguccaacagccgguuccccgucccgaucgacucccugcacacgagccccaccgagaacaucguggugcagugccagaacgggcgcgucacccucgacggcgagcugauggggaccacgcagcugcuccccucccagaucugcgccuuccggggcacccugacccgcagcaccucccgggccagcgaccaggcggacacggccacgccccgccuguucaacuacuacuggcacauccagcucgacaaccugaacggcaccccguacgaccccgccgaggacauccccgccccgcuggggacccccgacuuccggggcaagguguucgggguggccagccagcgcaaccccgacuccaccacccgggcgcacgaggccaaggucgacaccaccagcggccgcuucacgcccaagcucgggucccuggagaucagcaccgaguccggcgacuucgacccgaaccagcccacccgguucacccccgugggcaucggggucgacaacgaggccgacuuccagcaguggagccugcccgacuacuccggccaguucacgcacaacaugcaccucgccccggcgguggcccccaacuuccccggggagcagcugcuguucuuccgcagccagcuccccuccagcggcgggcgguccaacggcauccuggacugccuggugccgcaggaguggguccagcacuucuaccaggagagcgcccccgcccagacccagguggcccucgugcgcuacgucaaccccgacaccggccgcgugcuguucgaggcgaagcugcacaagcucggguucaugaccaucgccaagaacggcgacucccccaucacggugccgcccaacggguacuuccgguucgagagcugggucaaccccuucuacacccuggcccccaugggcaccgggaacggccgccggcgcauccaguga

SEQ ID NO: 9427 - RNA, 1644 nt, Artificial Sequence
  derived and/or modified sequence opt1 from VP1__Norovirus__AFN06730
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagaccaucguggugcagccccagaacggccgcugcacgcuggacggcacccuccaggggaccacccagcuggucccgacgcagaucugcuccuuccggggcacccugaucagccagaccucccgcagcgccgaguccaccgacagcgcgccccgggugcgcaaccacccccuccacguccagcugaagaaccuggacgggacgccguacgaccccaccgacgaggugcccgccgugcucggcgccaucgacuucaagggcaccgucuucgggguggccucccagcggaacaccacgggcagcagcgccggggccacccgcgcccacgaggugcacaucgacaccaccaacccccgguacacgccgaagcugggcuccguccugauguacagcgaguccaccgacuucgacgacgggcagcccacccgcuucacccccaucggcaugggcgcggacgacuggcggcagugggagcuccccgaguacagcgggcaccugacgcugaacaugaaccucgccccggccguggcccccgcguuccccggcgagcgcauccuguucuuccgcuccgugguccccagcgccgggggcuacggguccggccagaucgacugccugaucccgcaggagugggugcagcacuucuaccaggaggccgcccccagccaguccgccguggcgcucauccgguacgucaaccccgacaccggccgcaacaucuucgaggccaagcugcaccgggagggguucaucaccguggccaacagcggcaacaaccccaucguggucccgcccaacggguacuuccgcuucgaggccugggugaaccaguucuacacccugacgcccaugggcaccgggcagggccggcgccgggugcaguga

SEQ ID NO: 9428 - RNA, 1623 nt, Artificial Sequence
  derived and/or modified sequence opt1 from VP1__Norovirus__AFN06731
augaagauggccagcaacgacgccgcgcccuccagcgacggcgccgccgggcuggugccggagaucaacaacgaggucaugccccucgagcccguggccggcgccucccuggcgacccccguggucgggcagcagaacaucaucgacccguggauccgcaacaacuucgugcaggcccccgccggcgaguucaccgugagcccccggaacucccccggggagauccugcucgaccuggagcugggcccggagcucaaccccuaccuggcccaccuggcgcgcauguacaacggccacgccgggggcauggagguccagaucgugcucgccgggaacgccuucacggccggcaagaucaucuucgcggccaucccgcccggguuccccuacgagaaccugagccccucccagaucaccaugugcccccacgugaucaucgacguccggcagcuggagcccgugcuccugccgaugcccgacauccgcaacaacuucuuccacuacaaccagggcaacgaccccaagcugcggcucguggccaugcuguacacgccccugcgcgccaacaacagcggcgacgacgucuucaccguguccugccgggugcucaccaagccgagccccgacuucgaguucaccuuccuggucccgcccaccguggaguccaagaccaagcaguucacgcugcccauccucaagaucagcgagaugaccaacucccgcuuccccgugcccgucgacgugauguacaccgcccggaacgagaaccaggugguccagccccagaacgggcgcgugacccuggacggcgagcugcucgggacgaccccgcugcuggcggugaacaucugcaaguucaagggcgaggucaucgccaagaacggcgacgugcggagcuaccgcauggacauggagaucaccaacaccgacgggacgcccaucgaccccaccgaggacaccccgggccccaucgggucccccgacuuccagggcauccucuucggggucgccagccagcggaacaagaacgagcagaaccccgccacccgcgcccacgaggcgaacaucaacacgggcggcgaccaguacgccccgaagcuggcccaggugaaguucuucuccgagagccaggacuucgaggugcaccagcccaccaucuucacccccgucgggguggccggcgacaccucccaccccuuccggcaguggacgcugccgcgcuacgggggccaccucaccaacaacacccaccuggcccccgcgguggcgccccuguuccccggggagcagcuccuguucuuccggagccagaucccgagcuccggcggccacgagcagggguacauggacugccuggucccccaggagugggugcagcacuucuaccaggaggccgccaccgcccagagcgagguggcccucauccgcuucaucaaccccgacacgggccggguccuguucgaggccaagcugcacaagcagggguucaucaccguggcccacaccggcgacaaccccaucgugaugccgcccaacggguacuuccgcuucgaggccugggucaaccaguucuacucccucgcgcccgugggcaccggcaacgggcggcgccgcgugcaguga

SEQ ID NO: 9429 - RNA, 1623 nt, Artificial Sequence
  derived and/or modified sequence opt1 from VP1__Norovirus__AFN06732
augaagauggccagcaacgacgccgcgcccuccaacgacggcgccaccgggcuggugccggagaucaaccacgagacccucccccuggagcccgucgccggcgccgccaucgcggcccccgugacggggcagaacaacaucaucgacccguggauccgcaccaacuucgugcaggcccccaacggcgaguucaccgucagcccccggaacucccccggggagauccugcucaaccuggagcugggcccggaccucaaccccuaccuggcccaccugagccgcauguacaacggcuacgccgggggcguggaggugcagguccuccuggccgggaacgccuucaccgccggcaagauccuguucgccgcggugccgcccaacuuccccguggaguuccucucccccgcccagaucacgaugcugccccaccugaucgucgacgugcggacccucgagcccaucaugaucccgcugcccgacgugcgcaacaccuucuuccacuacaacaaccagcccgccaaccggaugcgccuggucgccaugcucuacacgccccugcggagcaacggguccggcgacgacguguucaccgugagcugccgcguccugacccggccgacccccgacuucgaguucaccuaccucgugccgcccuccguggagagcaagacgaagcccuucucccugcccauccugaccaucagcgagcucaccaacucccgcuuccccgcccccaucgacagccuguacaccgcgcagaacaacaaccugaacguccagugccagaacggccggugcacgcucgacggggagcugcagggcaccacccagcugcucccguccgggaucugcgccuuccgcggcaagcugaccgccgacgugcaccagagccacgacgaccgguggcacaugcagcugacgaaccucaacggcacccccuucgaccccaccgaggacgugccggcgccccuggggacccccgacuucacgggccuccuguucggggucgccucccagcgcaacguggugagcaaccccaacaccacccgggcgcacgaggccgucaucuccaccacgagcagccaguucgugccgaagcugggcuccaucaacuucgggagcaccuccgacgacuuccagcugcagcagcccaccaaguucacccccgucggcaucaagguggagagcggccacgacuucgaccagugggcccucccccgcuacuccgggcaccugacgcugaacaugaaccucgccccgcccguggcccccaacuuccccggcgagcagcugcuguucuuccggagcaacgucccgugcgccgggggcguguccgacggggugaucgacugccuccugccccaggaguggauccagcacuucuaccaggagagcgcgcccucccagagcgacgucgcccugauccgcuacgugaaccccgacaccggccggacccucuucgaggccaagcugcaccgcaccggcuacaucacgguggcgcacuccggggacuacccgcuggucgugcccagcaacggcuacuuccgguucgacuccugggugaaccaguucuacagccuggcccccauggggaccggcaacgggcgccgccggguccaguga

SEQ ID NO: 9430 - RNA, 1623 nt, Artificial Sequence
  derived and/or modified sequence opt1 from VP1__Norovirus__AFN06733
augaagauggccagcaacgacgccgcgcccuccaacgacggcgccgccgggcuggugccggagagcuccaacgaggccauggcccucgagcccgucgugggcgcgagccuggccgcccccgugaccgggcagaccaacaucaucgaccccuggauccgcacgaacuucguccaggccccgaacggcgaguucaccgugagcccccggaacucccccggggaggugcuggucaaccucgagcugggccccgagcugaacccguaccucgcgcaccuggccaugauguacaacggcuacgccgggggcauggagguccaggugcugcucgccgggaacgccuucaccgcgggcaagaucaucuucgccgccgugccgcccuacuuccccguggagaaccugucccccagccagaucaccauguucccccacgugaucaucgacguccgcacgcuggagcccgugcuccugcccaugccggacgugcgguccacccuguuccacuucaaccagaaggacgagcccaagaugcgccucgucgccaugcuguacacgccccugcggagcaacggguccggcgacgacguguucaccgugagcugccgcauccucacccggcccuccccggaguucgacuucaccuaccuggucccgcccaccguggagagcaagaccaagcccuucacgcugcccgugcucacccugggcgagcuguccaacagccgcuucccccucuccaucgacgagauggucaccagccccaacgaguccaucguggugcagccccagaacgggcgggucacccuggacggcgagcugcucgggacgacccagcugcaggccugcaacaucugcagcauccgcggcaaggugaccggccaggucccgaacgagcagcacauguggaaccuggagaucaccaaccucaacgggacgcaguucgaccccaccgacgacgugcccgcgccgcugggcgugcccgacuucgccggggaggucuucggcgugcugagccagcggaaccgcggggaguccaaccccgccaaccgggcccacgacgccguggucgcgaccuacagcgacaaguacacccccaagcucggccuggugcagaucggcacguggaacaccaacgacguggagaaccagccgaccaaguucacccccaucgggcugaacgaggucgccaacggccaccgcuucgagcaguggacgcucccccgguacuccggggcccugacccugaacaugaaccucgcccccgccguggcgccgcuguuccccggcgagcgccuccuguucuuccggagcuacgugccccugaagggcggguucggcaaccccgccaucgacugccuggucccgcaggagugggugcagcacuucuaccaggaguccgcccccagccucggggacguggcccugguccgcuacgugaaccccgacaccggccgggugcuguucgaggcgaagcuccacaagggcggguuccugaccgucuccagcacguccaccgggcccgugguggucccggccaacggcuacuuccgcuucgacagcugggugaaccaguucuacucccuggcccccaugggcaccgggaacggccggcgccgcuuccaguga

SEQ ID NO: 9431 - RNA, 1623 nt, Artificial Sequence
  derived and/or modified sequence opt1 from VP1__Norovirus__AFN06734
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguuccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacgugccccucaaggaccuguccaacagccgggugcccgucccgauccagggcauguucaugucccccgacgugaaccagagcgugcaguuccagaacgggcgcugccagaucgacggccagcugcaggggaccacccccgucucccucagccagcugugcaagauccggggcaagacguccagcaacgcccgcgugcugaaccucagcgaggucgacgggacccccuucaucccgcuggagucccccgcccccgugggcuucccggaccugggcgggugcgacuggcacgugaacuucaccuuccaggcgcagaaccaggaccccagccaguccgucaccuucgccacgaacgacgccagcuucgugcccuaccucggcuccaucagcccccacaacgggggcgacuuccacuccggggacaucaucggcagccugggcuggaucuccgccccgagcgacuccagccagcugaacguguggaccauccccaaguacggguccagccuccccgacgucacccaccuggcccccgcgguguucccgcccggcuucggggaggugauccuguacuuccacuccaccuuccccggcagcgggcagcccggccagcuccaggucccgugccugcugccccaggaguucaucacgcacuucugcaacgagcaggcccccaucgccggcgaggccgcgcuccugcacuacguggaccccgacaccgggcggaaccugggcgaguucaagcucuacccggacggguucaugaccugcgugcccaacuccgucagcuccggcccccagacccugcccaucaacggcguguucguguucgucagcugggugagccgcuucuaccagcugaagccgguggggacggccuccgccgcccggcgccucggccugcggcgcaucuga

SEQ ID NO: 9432 - RNA, 1632 nt, Artificial Sequence
  derived and/or modified sequence opt1 from VP1__Norovirus__AFN06735
augaugauggccagcaaggacgccucccccagcgcggacggcgccaacggggccggccagcuggugccggaggucaacaacgccgagccccucccccuggaccccguggccggggcguccaccgcccuggccaccgccggccaggugaacaugaucgacccguggaucuucaacaacuucguccaggcgccccagggggaguucacgaucagccccaacaacacccccggcgacauccucuucgaccugcagcugggcccgcaccucaaccccuuccuggcccaccugucccagauguacaacgggugggugggcaacaugcgcgugcgggucauccucgccgggaacgccuucaccgccggcaaggugaucaucugcugcgugccgcccggguuccagagccgcacccuguccaucgcgcaggccacgcuguucccccacaucaucgccgacguccggacccucgagcccaucgagaucccccuggaggacgugcgcaacacccuguaccacaccaacgacaaccagcccacgaugcggcuccugugcaugcuguacaccccgcuccgcaccggcggcgggagcggcgggaccgacgccuucguggucgccggccgggugcugacgugccccuccagcgacuucaacuuccuguuccucgugccgcccaccgucgagcagaagacccgccccuucuccgugcccaacaucccccugcagcugcucagcaacucccgggugcccaaccugauccagagcaugguccuguccccggaccaggcgcagaacgugcaguuccagaacggccgcugcaccacggacgggcagcuccugggcaccacccccgugagcgucucccagauccugaaguuccgggggaaggugagcgccggcucccgcgugaucaaccucaccgagcuggacgggagccccuuccuggccuucgaggcccccgccccgacgggcuuccccgaccucggcaccagcgacuggcacgucgagaugucccugaacagcaacucccagagcuccgggaaccccauccugcuccgggacauccagccgaacagcuccgacuucgugccccaccugggcagcgucuccgugaccaccgcgaucgacguggccggggacuacacgggcaccauccaguggaccagccagcccuccaacgucacccccgugccggacgugaacuucuggacgaucccccaguacgggagcaaccuggccgaggccucccagcucgcccccgucguguacccgcccggcuucggcgaggcgaucguguacuucaugagccccauccccgggcccaacaccgcccacaagccgaaccugguccccugccugcucccccaggaguucgugacccacuucguguccgagcaggcccccagcaugggcgaggccgcgcugguccacuacguggacccggacaccaaccgcaaccugggggaguucaagcucuaccccgagggcuucaucacgugcgugcccaacgggaccggcccccagcagcugccgcugaacggcgucuucguguucgccuccugggugagccgguucuaccagcucaagcccgucgggaccgccuccagcgcccgcggccggcugggggugcgccgguga

SEQ ID NO: 9433 - RNA, 1635 nt, Artificial Sequence
  derived and/or modified sequence opt1 from VP1__Norovirus__AFN06736
augaugauggccagcaaggacgcccccaccaacauggacggcaccuccggggcgggccagcuggugccggaggccaacacggccgagcccaucagcauggaccccgucgccggggccgcgaccgccguggccaccgccggccagaucaacaugaucgaccccuggaucauguccaacuucgugcaggcgccgcagggggaguucaccgucagccccaacaacacgcccggcgacguccucuucgaccugcagcugggcccccagcucaacccguuccuggcccaccuggcccagauguacaacgggugggugggcaacaugcgcgugaaggugcuccuggccgggaacgccuucaccgcgggcaagaucaucaucuccugcaucccgcccggguucaccagccagaacaucuccaucgcccagaugaccauguucccccacgugaucgccgacguccgggugcuggagcccaucgagaucccccucgaggacgugcgcaacguccuguuccacacgaacgacaaccggcccaccaugcgccuggugugcaugcucuacacgccccugcgggccaacggcagcuccagcggcaccgacccguucgugaucgccgggcgcguccugaccugccccgacuccaacuucagcuuccucuuccuggugccgcccaacguggagcagaagacccggcccuucuccguccccaacaucccccugaacacccucagcaacucccgcgugcccagccugaucaaguccaugaccaucagccgggaccagaaccagaucauccaguuccagaacggccgcgugacgcuggacgggcagcuccagggcaccaccccgaccuccgucagccagcugugcaagauccggggcacgaccuaccacgcgaccgggggcaacgggaucaaccugaccgagcucaacggcgagcccuaccacgccuucgagagccccgcccccaucggguucccggaccugggcggcugcgacuggcaccugacggccacccccacccaggccuucaacgacggggcgaagguggugcgccucuccgucacccagggcgccgccuucgcgccccaccuggggacgauccacuacaccaccaccgaccacgacuacgacccgaacacgagcaucaucugcacccuggacuggcucucccagaccaccggccagaacaacguggaccccuggcagauccccacguacgggagcacccugaccgaggccgcccagcuggcgcccccgaucuucccgcccggcuucggcgagacccucgucuucuuccuguccgacuuccccaucagcaacgggaagaacggccuguccgugcccugcacccucccccaggaguucgugacgcacuucgucaacgagcaggcccccauccgcggggaggccgcccugcugcacuacguggaccccgacacccaccggaaccucggcgaguucaagcuguacccggagggguucaugaccugcgugcccaacaccagcggcggcgggccccagacgcugcccaucaacggcgucuucguguucguguccugggucagccgguucuaccagcucaagccgguggggaccgccggcgccgcccgccggcugggcauccgccgguccuga

SEQ ID NO: 9434 - RNA, 1635 nt, Artificial Sequence
  derived and/or modified sequence opt1 from VP1__Norovirus__AFN06738
augaugauggccagcaaggacgcccccaccaacauggacggcaccuccggggcgggccagcuggugccggaggccaacacggccgagcccaucagcauggagcccgucgccggggccgcgaccgccgccgccaccgcgggccaggugaacaugaucgaccccuggaucaugaacaacuacgugcaggccccgcagggggaguucaccaucucccccaacaacacgcccggcgacauccucuucgaccugcagcugggcccccaccucaacccguuccugagccaccuggcccagauguacaacgggugggucggcaacaugaaggugaaggugcuccuggccgggaacgccuucaccgcgggcaagaucaucaucuccugcaucccgcccggguucgccagccagaacaucuccaucgcccaggccaccauguucccccacgucaucgccgacgugcgcgugcuggagcccaucgaggucccccucgaggacgugcggaacgugcuguuccacaacaacgacaacacccccacgaugcgccuggucugcaugcucuacacgccccugcgggcgagcggcuccagcuccggcaccgacccguucgugaucgccgggcgcgugcugaccugccccagccccgacuucuccuuccucuuccuggugcccccgaacgucgagcagaagaccaagcccuucagcgugcccaaccugccccucaacguccuguccaacagccgggugccgucccugaucaaguucaugauggugagccaggaccacggccagaugguccaguuccagaacgggcgcgugacccucgacggccagcugcagggcaccacccccacguccgccagccagcugugcaagaugcgggggaccguguaccacgccagcggcgggcagggccucaaccugaccgagaucgacgggacccccuaccacgccuucgagucccccgcgccgaucggcuuccccgaccugggcgacagcgacuggcacaucaacgccucccccgccacgaccuucaacaccggggagagcgucaagcgccucgacauggagcagggcuccagcuucgccccgcaccuggggaccgugcacuacacgaacgccgacuacgacgcgaacaccgaccugaucugcucccucgaguggcugagcccgcccuccggcgggacccccaacaaggucaaccccugggccaucccccgguacggcagcacccugacggaggccgcccagcucgcgccgcccaucuacccgcccggcuucggggaggccaucguguucuucauguccgacuuccccaucgccaacggccaggacgggcugaaggugcccugcaccaucccccaggaguucgucacccacuucgugaacgagcaggcccccacccgcggcgaggccgcgcugcuccacuacguggaccccgacacgcaccggaaccugggggaguucaagcuguaccccgagggcuucaugaccugcgucccgaacagcuccggcagcgggccccagacccuccccaucaacggcguguucaccuucguguccugggucagccgcuucuaccagcugaagcccguggggacgaccggcccggugcggcgccugggcauccggcgcuccuga

SEQ ID NO: 9435 - RNA, 1635 nt, Artificial Sequence
  derived and/or modified sequence opt1 from VP1__Norovirus__AFN06739
augaugauggccagcaaggacgcccccaccaacauggacggcaccuccggggcgggccagcuggugccggaggccaacacggccgagcccaucagcauggagcccgucgccggggccgcgaccgccgccgccaccgcgggccaggugaacaugaucgaccccuggaucaugaacaacuacgugcaggccccgcagggggaguucaccaucucccccaacaacacgcccggcgacauccucuucgaccugcagcugggcccccaccucaacccguuccugagccaccuggcccagauguacaacgggugggucggcaacaugaaggugaaggugcuccuggccgggaacgccuucaccgcgggcaagaucaucaucuccugcaucccgcccggguucgccagccagaacaucuccaucgcccaggccaccauguucccccacgucaucgccgacgugcgcgugcuggagcccaucgaggucccccucgaggacgugcggaacgugcuguuccacaacaacgacaacacccccacgaugcgccuggucugcaugcucuacacgccccugcgggcgagcggcuccagcuccggcaccgacccguucgugaucgccgggcgcgugcugaccugccccagccccgacuucuccuuccucuuccuggugcccccgaacgucgagcagaagaccaagcccuucagcgugcccaaccugccccucaacguccuguccaacagccgggugccgucccugaucaagagcaugauggugucccaggaccacggccagaugguccaguuccagaacgggcgcgugacccucgacggccagcugcagggcaccacccccacgagcgccagccagcugugcaagaugcgggggaccguguaccacgccuccggcgggcagggccucaaccugaccgagaucgacgggacccccuaccacgccuucgagagccccgcgccgaucggcuuccccgacaucggcgacuccgacuggcacaucaacgccagccccgccacgaccuucgacuccggggagagcaucaagcgccuggacauggagcagggcuccagcuucgccccgcaccucgggaccguccacuacaccaacgccgacuaccccgcgaacacggaccugaucugcucccuggaguggcucagcccgcccuccggcgggacccccaacaaggugaaccccuggaccaucccccgguacggcagcacccugacggaggccgcccagcuggcgcccccgaucuacccgcccggcuucggggaggccaucgucuucuucauguccgacuuccccaucgccaacggccaggacgggcucaaggugcccugcaccaucccccaggaguucgugacccacuucgucaacgagcaggcccccacccgcggcgaggccgcccugcugcacuacguggaccccgacacgcaccggaaccucggggaguucaagcuguacccggagggcuucaugaccugcgugcccaacagcuccggcagcgggccccagacccugcccaucaacggcgucuucaccuucguguccugggugagccgcuucuaccagcucaagccggucgggacgaccggccccgugcggcgccugggcauccggcgcuccuga

SEQ ID NO: 9436 - RNA, 1623 nt, Artificial Sequence
  derived and/or modified sequence opt1 from VP1__Norovirus__AFV08771
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccauccugacgguggaggagaugaccaacagccgguuccccaucccccuggagaagcuguucaccggccccuccagcaccuucgugguccagccgcagaacgggcgcugcacgaccgacggcgugcuccuggggaccacccagcucucccccgucaacaucugcacguuccggggcgacgugacccacaucgccggcagccgcaacuacaccaugaaccuggccucccagaacuggaacagcuacgaccccaccgaggagaucccggcgccccuggggacgcccgacuucgugggcaagauccaggggguccucacccagaccacccggacggacggcagcacccgcgggcacaaggccaccguguacaccggcuccgccgacuucagccccaagcugggccgggugcaguucgccacggacaccgacaacgacuucgacgccaaccagaacaccaaguucaccccggucggggugauccaggacggcaacacggcccaccgcaacgagccccagcagugggugcugcccuccuacagcgggcggaacacccacaacguccaccucgcgcccgccguggccccgaccuuccccggcgagcagcugcuguucuuccgcuccaccaugcccgggugcagcggcuaccccaacauggaccucgacugccugcugccgcaggagugggugcaguacuucuaccaggaggccgcgcccgcccaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgggcgcucuga

SEQ ID NO: 9437 - RNA, 1623 nt, Artificial Sequence; identical to SEQ ID NO: 9034
  derived and/or modified sequence opt1 from VP1__Norovirus__AFV08774

SEQ ID NO: 9438 - RNA, 1623 nt, Artificial Sequence
  derived and/or modified sequence opt1 from VP1__Norovirus__AFV08777
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccagcuucccgaucgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcaccaagcccuucuccguccccgugcugacgguggaggagaugaccaacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcaacgugacgcacaucagcggcagccgcaacuacaccaugaaccuggccucccagaacuggaacagcuacgacccgaccgaggagauccccgcgccccuggggacccccgacuucgucggcaagauccagggggugcucacgcagaccaccaagaccaacggcuccacgcgggggcacaaggccaccguguacaccggcagcgccgacuucuccccgaagcugggccgcguccaguucgccaccgacacggacaacgacuucgagaccaaccagaacaccaaguucacccccgugggggugauccaggacggcagcacgacgccccggaacgagccccagcaguggguccugccguccuacagcgggcgcaacacccacaacgugcaccucgcccccgccguggcccccaccuuccccggcgagcagcugcuguucuuccgguccaccaugccggggugcagcggcuaccccaacauggaccucgacugccugcugccccaggaguggguccaguacuucuaccaggaggcggcccccgcccaguccgacguggcccuccugcgcuucgugaacccggacaccggccggguccuguucgagugcaagcuccacaagagcggguacgugaccguggcgcacaccggccagcacgaccuggucaucccgcccaacggguacuuccgcuucgacuccugggugaaccaguucuacacccuggcccccaugggcaacgggacgggccggcgccgcgcccucuga

SEQ ID NO: 9439 - RNA, 1623 nt, Artificial Sequence
  derived and/or modified sequence opt1 from VP1__Norovirus__AFV08780
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucgccccgaagcugggccgggugcaguucgccaccgacaccgaccacgacuucgacgccaaccagaacaccaaguucacgcccgucggggugauccaggacggcgacaccgcgcaccgcaacgagccccagcagugggugcugcccuccuacagcgggcggaacucccacaacguccaccucgccccgaccguggcccccaccuuccccggcgagcagcugcuguucuuccgcagcacgaugcccgggugcuccggcuacccgaacauggaccucgacugccugcugccccaggagugggugcaguacuucuaccaggaggccgcgcccgcccagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgggcgcucuga

SEQ ID NO: 9440 - RNA, 1623 nt, Artificial Sequence
  derived and/or modified sequence opt1 from VP1__Norovirus__AFV08783
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccaggggaugcucacccagaccacccggacggacggcuccacccgcgggcacaaggccaccguguacaccggcagcgccgacuucuccccgaagcugggccgggugcaguucgccacggacaccgacaacgacuucgucaccaaccagaacaccaaguucacgcccgugggggugauccaggacggcagcaccacgccccgcaacgagccccagcaguggguccugccguccuacagcgggcggaacacccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagaccggguacgugaccguggcgcacacgggccagcacgaccuggucaucccgcccaacggguacuuccgguucgacagcugggugaaccaguucuacacccuggcccccaugggcaacgggaccggccgccgccgggcccucuga

SEQ ID NO: 9441 - RNA, 1623 nt, Artificial Sequence
  derived and/or modified sequence opt1 from VP1__Norovirus__AFV08786
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9442 - RNA, 1623 nt, Artificial Sequence
  derived and/or modified sequence opt1 from VP1__Norovirus__AFV08789
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucggcacggacaccgagaacgacuucgagacccaccagaacaccaaguucacgcccgucggggugauccaggacggcgggaccacccaccgcaacgagccccagcagugggugcuccccuccuacagcggccgggacgucccgaacgugcaccuggcccccgccguggcgcccaccuuccccggcgagcagcuccucuucuuccgcuccacgaugccggggugcagcggcuaccccaacauggaccuggacugccugcucccccaggaguggguccagcacuucuaccaggaggccgcccccgcccaguccgacguggcgcugcugcgguucgugaacccggacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcgcccuguga

SEQ ID NO: 9443 - RNA, 1623 nt, Artificial Sequence
  derived and/or modified sequence opt1 from VP1__Norovirus__AFV08792
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccaucccccuggagaagcuguucaccggccccagcuccgccuucgucgugcagccgcagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgaccccaccgacgagaucccggcgccccuggggacgcccgacuucgugggcaagauccaggggaugcucacccagaccacccggacggacggcagcacccgcgggcacaaggccaccgucuacaccggcuccgccgacuucgcccccaagcugggccgggugcaguucgagacggacaccgaccacgacuucgaggccaaccagaacaccaaguucaccccggugggggucauccaggacggcagcacgacccaccgcaacgagccccagcagugggugcugcccuccuacagcgggcggaacacccacaacgugcaccucgcccccgcggucgccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacguggcccuccugcgguucgucaaccccgacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgggucguguga

SEQ ID NO: 9444 - RNA, 1623 nt, Artificial Sequence
  derived and/or modified sequence opt1 from VP1__Norovirus__AFV08795
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacgacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccgcgacuucgaggccaaccagaacaccaaguucacccccgucggggugauccaggacggcgggacgacccaccggaacgagccccagcagugggugcugcccuccuacagcggccgcaacacccacaacguccaccucgccccggcgguggcccccaccuuccccggggagcagcugcuguucuuccgguccacgaugcccggcugcagcggcuacccgaacauggaccucgacugccugcugccccaggagugggugcaguacuucuaccaggaggccgcccccgcgcaguccgacgucgcccuccugcgcuucgugaaccccgacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccgccggcgcgccguguga

SEQ ID NO: 9445 - RNA, 1623 nt, Artificial Sequence
  derived and/or modified sequence opt1 from VP1__Norovirus__AFX95940
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcugcccuccuacagcgggcgcaacaccccgaacguccaccucgcccccgcgguggcccccaccuuccccggcgagcagcugcuguucuuccgguccacgaugccggggugcagcggcuaccccaacauggaccucgacugccugcugccccaggagugggugcaguacuucuaccaggaggccgcccccgcgcaguccgacgucgcccuccugcgcuucgugaacccggacaccggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggacgggccgccggcgcgcccucuga

SEQ ID NO: 9446 - RNA, 1620 nt, Artificial Sequence
  derived and/or modified sequence opt1 from VP1__Norovirus__AFZ84663
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugagcaacucccgguuccccaucccccuggagaagcucuacaccggccccagcuccgccuucgugguccagccgcagaacgggcgcugcacgaccgacggcgugcugcuggggaccacccagcucagcgccgucaacaucugcacguuccggggcgacgugacccacaucgccggcucccacgacuacaccaugaaccuggccagccagaacuggaacaacuacgaccccaccgaggagauccccgcgccgcuggggacgcccgacuucgugggcaagauccaggggaugcucacccagaccacccgcgaggacggcagcacgcgggcccacaaggccaccgucuccaccgggagcgugcacuucacccccaagcugggcuccgugcaguacacgaccgacaccaacaacgacuuccagaccggccagaacacgaaguucacccccgucggggugauccaggacggcaacaaccaccagaacgagccgcagcagugggugcugcccaacuacagcgggcgcaccggccacaacguccaccucgcccccgccguggcgcccaccuucccgggggagcagcugcuguucuuccgguccacgaugcccggcugcagcggcuaccccaacaugaaccucgacugccugcugccccaggagugggugcagcacuucuaccaggaggccgccccggcccaguccgacgucgcgcuccugcgcuucgugaaccccgacaccgggcgggugcuguucgagugcaagcuccacaagagcggcuacgucaccguggcccacaccgggccccacgaccuggugaucccgcccaacggcuacuuccgcuucgacuccugggucaaccaguucuacacccuggcccccauggggaacggcgccggccggcgccgggugcucuga

SEQ ID NO: 9447 - RNA, 1623 nt, Artificial Sequence
  derived and/or modified sequence opt1 from VP1__Norovirus__AGG37871
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgaggucgcccuccugcgguucgugaaccccgacaccgggcgcgugcuguucgagugcaagcuccacaagagcggcuacgucaccguggcccacaccgggcaguacgaccuggugaucccgcccaacggcuacuuccgguucgacuccugggucaaccaguucuacacccuggcccccauggggaacggcacgggccgccgccgggccguguga

SEQ ID NO: 9448 - RNA, 1623 nt, Artificial Sequence
  derived and/or modified sequence opt1 from VP1__Norovirus__AGI96383
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacauccccggcucccacaacuacaccaugaaccuggccagccagaacuggaacagcuacgacccgaccgaggagauccccgcgccccuggggacgcccgacuucgugggcaagauccaggggguccucacccagaccaccuccacgaacggcagcacccgcgggcacaaggccaccguguacaccggcuccgccgacuucagcccgaagcugggccgggugcaguucuccacggacaccaacaacgacuucgagaccaaccagaacaccaaguucacgcccgucggggugauccaggacggcagcaccacgccccgcaacgagccccagcagugggugcugccguccuacagcgggcggaacauccacaacguccaccucgcccccgccguggcccccaccuuccccggcgagcagcugcuguucuuccgcuccaccaugccggggugcagcggcuaccccaacauggaccucgacugccugcugccccaggagugggugcaguacuucuaccaggaggccgcgcccgcccaguccgacgucgcccuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacccuggcgcccaugggcaacgggacgggccgccggcgcgcccucuga

SEQ ID NO: 9449 - RNA, 1623 nt, Artificial Sequence
  derived and/or modified sequence opt1 from VP1__Norovirus__AGI99552
augaagauggccagcuccgacgccaaccccagcgacggcuccgcggccaaccuggugccgaaggucaacaacgaggugauggcccucgagcccguggucggggccgccaucgcggcccccguggccggccagcagaacgugaucgaccccuggaucaagaacaacuucguccaggcccccgggggcgaguucaccgugagccccaagaacgcgcccggggagauccugugguccgcgccccugggcccggaccucaaccccuaccugagccaccuggccaagauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccgccagcuggagcccgugcucaucccgcugcccgacgugcggaacaacuucuaccacuacaaccaguccaacgaccccaccaucaagcugaucgccaugcucuacacgccccugcgcgcgaacaacgccggcgacgacgucuucaccgugagcugccgggugcugacccgcccgucccccgacuucgacuucaucuuccucgucccgcccaccguggagagccggaccaagcccuucuccgugcccguccugacgguggaggagaugaccaacagccgcuuccccaucccccuggagaagcuguucaccggcccguccagcgccuucgucgugcagccccagaacgggcggugcaccacggacggcgugcuccuggggaccacccagcucucccccgucaacaucugcaccuuccgcggcgacgugacgcacaccaucggcagccggaacuacaccaugaaccuggccucccagaacuggaacaacuacgacccgaccgaggagauccccgcgccccuggggacgcccgacuucgugggcaagauccaggggguccucacccagaccacccgcacggacggcagcacccgggggcacaaggccaccguguacaccggcagcgccgacuucgccccgaagcugggccgcgugcaguucgagacggacaccgaccacgacuucgaggccaaccagaacaccaaguucacccccgucggggugauccaggacggcuccacgacccaccggaacgagccccagcagugggugcugcccagcuacuccgggcgcaacacccacaacguccaccucgccccggcgguggcccccaccuuccccggcgagcagcugcuguucuuccggagcacgaugcccgggugcuccggcuacccgaacauggaccucgacugccugcugccccaggagugggugcaguacuucuaccaggaggccgcccccgcgcagagcgacgucgcccuccugcgcuucgugaaccccgacaccggccgggugcuguucgagugcaagcuccacaaguccggguacgucaccguggcccacaccggccagcacgaccuggugaucccgcccaacggguacuuccgcuucgacagcugggucaaccaguucuacacccuggcccccaugggcaacgggacgggccggcgccggccccucuga

SEQ ID NO: 9450 - RNA, 1623 nt, Artificial Sequence
  derived and/or modified sequence opt1 from VP1__Norovirus__AGI99553
augaagauggccagcuccgacgccaacccgcccgacggcagcgcggccaaccuggugcccaaggucaacaacgaggugauggcccucgagcccguggucggggccgccaucgcggcccccguggccggccagcagaacgugaucgacccguggaucaagaacaacuucguccaggcccccgggggcgaguucaccgugucccccaagaacgcgcccggggagauccuguggagcgccccgcugggccccgaccucaaccccuaccugucccaccuggcccgcauguacaacggcuacgccgggggcuucgaggugcaggucauccucgccgggaacgcguucaccgccggcaaggugaucuucgccgccgugcccccgaacuuccccacggaggggcugagccccucccaggucaccauguucccccacaucgugguggacguccggcagcuggagccggugcucaucccccugcccgacgugcgcaacaacuucuaccacuacaaccagagcaacgaccccaccaucaagcugaucgccaugcucuacaccccgcugcgggcgaacaacgccggcgacgacgucuucacgguguccugccgcgugcugacccggcccagccccgacuucgacuucaucuuccucgugcccccgaccgucgagucccgcaccaagcccuucagcgugcccguccugacgguggaggagaugaccaacucccgguuccccaucccgcuggagaagcuguucaccggccccagcuccgccuucgucgugcagccccagaacgggcgcugcaccacggacggcgugcuccuggggaccacccagcucagcccggucaacaucugcaccuuccggggcgacgugacgcacaucaccggcucccgcaacuacaccaugaaccuggccagccagaacuggaacaacuacgaccccaccgaggagauccccgcgccccuggggacgccggacuucgugggcaagauccaggggguccucacccagaccacccggacggacggcuccacccgcgggcacaaggccaccguguacaccggcagcgccgacuucgcccccaagcugggccgggugcaguucgagacggacaccgaccacgacuucgaggccaaccagaacaccaaguucacccccgucggggugauccaggacggcagcacgacccaccgcaacgagccccagcagugggugcugccguccuacagcgggcgggacacccacaacguccaccucgcccccgcgguggcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacgucgcccuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccggcgcccccucuga

SEQ ID NO: 9451 - RNA, 1623 nt, Artificial Sequence
  derived and/or modified sequence opt1 from VP1__Norovirus__AGI99554
augaagauggccagcuccgacgccaaccccagcgacggcuccgcggccaaccuggugccgaaggucaacaacgaggugauggcccucgagcccguggucggggccgccaucgcggcccccguggccggccagcagaacgugaucgaccccuggaucaagaacaacuucguccaggcccccgggggcgaguucaccgugagccccaagaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcugcccuccuacagcgggcgcaacaccccgaacguccaccucgcccccgcgguggcccccaccuuccccggcgagcagcugcuguucuuccgguccacgaugccggggugcagcggcuaccccaacauggaccucgacugccugcugccccaggagugggugcaguacuucuaccaggaggccgcccccgcgcaguccgacgucgcccuccugcgcuucgugaacccggacaccggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggacgggccggcgccgcccccucuga

SEQ ID NO: 9452 - RNA, 1623 nt, Artificial Sequence
  derived and/or modified sequence opt1 from VP1__Norovirus__AGI99555
augaagauggccagcuccgacgccaaccccagcgacggcuccgcggccaaccuggugccgaaggucaacaacgaggugauggcccucgagcccguggucggggccgccaucgcggcccccguggccggccagcagaacgugaucgaccccuggaucaagaacaacuucguccaggcccccgggggcgaguucaccgugagccccaagaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccggcgcccccucuga

SEQ ID NO: 9453 - RNA, 1623 nt, Artificial Sequence
  derived and/or modified sequence opt1 from VP1__Norovirus__AGK25882
augaagauggccagcaacgacgccucccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcgccuggagcccgugcucaucccgcugcccgacguccggaacaacuucuaccacuacaaccaguccaacgacagcaccaucaagcugaucgccaugcucuacacgccccugcgcgcgaacaacgccggcgaggacguguucaccguguccugccggguccugacccgccccagcccggacuucgacuucaucuuccucgugccgcccaccguggagucccggaccaagcccuucacgguccccauccugaccguggaggagaugaccuacagccgcuuccccaucccccuggagaagcuguucaccggccccuccagcgccuucgugguccagccgcagaacgggcggugcacgaccgacggcgugcugcuggggaccacccagcucucccccgucaacaucugcacguuccgcggcgacgugacccacaucgccggcagccggaacuacaccaugaaccuggccucccugaacuggaacaacuacgaccccaccgaggagaucccggcgccccucgggacgcccgacuucgugggcaagauccaggggaugcugacccagaccaccaagggcgacgggagcacgcgcggccacaaggccaccgucuacaccggcagcgcccccuucaccccgaagcugggguccgugcaguucgagacggacaccgagaacgacuucgagacccaccagaacaucaaguucacccccgugggcgucauccaggacgggggcacgacccaccggaacgagccccagcagugggugcuccccagcuacuccgggcgcaacgugccgaacguccaccuggcccccgccguggcgcccaccuuccccggcgagcagcuccucuucuuccggagcaccaugccgggcugcuccggguaccccaacauggaccuggacugccugcucccccaggagugggugcagcacuucuaccaggaggccgcccccgcccagagcgacgucgcgcugcugcgcuucgugaacccggacacgggccggguccucuucgagugcaagcugcacaaguccggguacgugaccguggcccacaccggccagcacgaccugaucaucccgcccaacggguacuuccgcuucgacagcugggugaaccaguucuacacccucgcccccaugggcaacggcaccgggcggcgccgcgcccuguga

SEQ ID NO: 9454 - RNA, 1623 nt, Artificial Sequence
  derived and/or modified sequence opt1 from VP1__Norovirus__AGK25884
augaagauggccagcaacgacgccucccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggaugcugacccagaccgccaagggcgacgggagcacccggggccacaaggccacggucuacaccggcagcgcccccuucaccccgaagcugggguccgugcaguucgagaccgacacggagaacgacuucgagacccaccagaacaccaaguucacccccgugggcgucauccaggacgggggcacgacccaccgcaacgagccccagcagugggugcuccccagcuacuccgggcggaacgugccgaacguccaccuggcccccgcgguggcccccaccuuccccggcgagcagcuccucuucuuccgcagcaccaugccgggcugcuccgggugccccgacauggaccuggacugccugcucccccaggagugggugcagcacuucuaccaggaggccgcccccgcgcagagcgacgucgcccugcugcgguucgugaacccggacacgggccgcguccucuucgagugcaagcugcacaaguccggguacgugaccguggcccacaccggccagcacgaccugaucaucccgcccaacggguacuuccgguucgacagcugggugaaccaguucuacacccucgcccccaugggcaacggcaccgggcgccggcgcgcccuguga

SEQ ID NO: 9455 - RNA, 1623 nt, Artificial Sequence
  derived and/or modified sequence opt1 from VP1__Norovirus__AGK25887
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacaucacgcacaucaccggcagccgcaacuacaccaugaaccuggccucccagaacuggaacaacuacgacccgaccgaggagauccccgcgccccuggggacgcccgacuucgugggcaagauccagggggugcucacccagaccacccggacggacggcagcacccgcgggcacaaggccaccguccacaccggcagcgccgacuucgccccgaagcugggccgggugcaguucgagacggacaccgaccacgacuucgaggccaaccagaacaccaaguucacccccgugggggucauccaggacggcgggacgacccaccgcaacgagccccagcagugggugcugcccuccuacagcggccggaacacccacaacgugcaccucgccccggcggucgcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacguggcccuccugcgguucgucaaccccgacaccgggcgcgugcuguucgagugcaagcuccacaagagcggcuacgugaccgucgcccacaccgggcagcacgaccuggugaucccgcccaacggcuacuuccgguucgacuccugggugaaccaguucuacacccuggcccccauggggaacggcacgggccgccgccgggccgucuga

SEQ ID NO: 9456 - RNA, 1623 nt, Artificial Sequence
  derived and/or modified sequence opt1 from VP1__Norovirus__AGK25890
augaagauggccagcuccgacgccaaccccagcgacggcuccgcggccaaccuggugccggaggucaacaacgaggugaucgcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacaucgcccacaucacgggcagccgcaacuacaccaugaaccuggccucccagaacuggaacaacuacgacccgaccgaggagauccccgcgccccuggggacccccgacuucgugggcaagauccagggggugcucacgcagaccacccggaccgacggcagcacgcgcgggcacaaggccaccgucuacaccggcagcgccgacuucgccccgaagcugggccgggugcaguucgagaccgacacggaccacgacuucgaggccaaccagaacaccaaguucacccccgugggggucauccaggacggcgggaccacgcaccgcaacgagccccagcagugggugcugcccuccuacagcggccggaacacccacaacgugcaccucgcgccggccgucgcccccaccuuccccggggagcagcugcuguucuuccgcuccaccaugcccggcugcagcggcuacccgaacauggaccucgacugccugcugccccaggagugggugcaguacuucuaccaggaggccgcgcccgcccaguccgacguggcccuccugcgguucgucaaccccgacacggggcgcgugcuguucgagugcaaccuccacaagagcggcuacgugaccgucgcccacaccgggcagcacgaccuggugaucccgcccaacggcuacuuccgguucgacuccugggugaaccaguucuacacccuggcccccauggggaacggcaccggccgccgccgggcggucuga

SEQ ID NO: 9457 - RNA, 1623 nt, Artificial Sequence; identical to SEQ ID NO: 8842
  derived and/or modified sequence opt1 from VP1__Norovirus__AGK25892

SEQ ID NO: 9458 - RNA, 1623 nt, Artificial Sequence
  derived and/or modified sequence opt1 from VP1__Norovirus__AGK25898
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggacaccacccagcucagccccgucaacaucugcacguuccgcggggacgugacccacaucgccggcucccggaacuacaccaugaaccuggccagccugaacuggaacaacuacgaccccaccgaggagaucccggcgccccucggcacgcccgacuucguggggaagauccagggcaugcugacccagaccaccaagggggacggcuccacgcgggggcacaaggccaccgucuacaccggcagcgcccccuucaccccgaagcugggcagcgugcaguucgagacggacaccgagaacgacuucgagacccaccagaacaccaaguucacgcccgugggggucauccaggacggcgggaccacccaccgcaacgagccccagcagugggugcuccccuccuacagcggccggaacgugccgaacgcccaccuggcccccgcggucgcccccaccuuccccggggagcagcuccucuucuuccgcuccacgaugccgggcugcagcggcuaccccaacauggaccuggacugccugcucccccaggagugggugcagcacuucuaccaggaggccgcccccgcgcaguccgacguggcccugcugcgguucgucaacccggacaccgggcgcguccucuucgagugcaagcugcacaagagcggcuacgugaccgccgcccacaccgggcagcacgaccuggugaucccgcccaacggcuacuuccgguucgacuccugggugaaccaguucuacacccucgcccccauggggaacggcacgggccgccggcgcgcgcuguga

SEQ ID NO: 9459 - RNA, 1623 nt, Artificial Sequence
  derived and/or modified sequence opt1 from VP1__Norovirus__AGK25900
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucgccggcucccgcaacuacaccaugaacagcgccucccugaacuggaacaacuacgaccccaccgaggagaucccggcgccccuggggacgcccgacuucgugggcaagauccaggggaugcucacccagaccaccaagggcgacgggagcacgcggggccacaaggccaccgucuacaccggcagcgcccccuucaccccgaagcugggguccgugcaguucgagacggacaccgagaacgacuucgagacccaccagaacaccaaguucacgcccgugggcgucauccaggacgggggcaccacccaccgcaacgagccccagcagugggugcugcccagcuacuccgggcggaacgugccgaacguccaccucgcccccgccguggcgcccaccuuccccggcgagcagcugcuguucuuccgcagcacgaugccgggcugcuccggguaccccaacauggaccucgacugccugcugccccaggagugggugcagcacuucuaccaggaggccgcccccgcccagagcgacgucgcgcuccugcgguucgugaacccggacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacggcacggggcgccggcgcgcccucuga

SEQ ID NO: 9460 - RNA, 1623 nt, Artificial Sequence
  derived and/or modified sequence opt1 from VP1__Norovirus__AGK25902
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgccagcugccgcgugcugacccggcccuccccggacuucgacuucaucuuccucgucccgcccaccguggagagccgcaccaagcccuucacggugcccauccugaccgucgaggagaugaccaacucccgguuccccaucccccuggagaagcuguucaccggccccagcuccgccuucguggugcagccgcagaacgggcgcugcacgaccgacggcguccugcuggggaccacccagcucagccccgugaacaucugcacguuccggggcgacgucacccacaucgccggcucccgcaacuacaccaugaaccuggcgagccugaacuggaacaacuacgaccccaccgaggagaucccggcgccccucgggacgcccgacuucgugggcaagauccaggggaugcugacccagaccaccaagggcgacggguccacgcggggccacaaggccaccguguacaccggcagcgcccccuucaccccgaagcuggggagcguccaguucgagacggacaccgagaacgacuucgagacccaccagaacaccaaguucacgcccgugggcgugauccaggacgggggcaccgcccaccgcaacgagccccagcaguggguccuccccuccuacagcgggcggaacgugccgaacgugcaccuggcccccgccgucgcccccaccuuccccggcgagcagcuccucuucuuccgcuccaccaugccgggcugcagcggguaccccaacauggaccuggacugccugcucccccaggagugggugcagcacuucuaccaggaggccgcgcccgcccaguccgacguggcccugcugcgguucgucaacccggacacgggccgcguccucuucgagugcaagcugcacaagagcggguacgugaccguggcccacaccggccagcacgaccuggugaucccgcccaacggguacuuccgguucgacuccugggugaaccaguucuacacccucgcccccaugggcaacggcaccgggcgccggcgcgcgcuguga

SEQ ID NO: 9461 - RNA, 1623 nt, Artificial Sequence
  derived and/or modified sequence opt1 from VP1__Norovirus__AGK25905
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucgcccaggcgcccgggggcgaguucaccgucagcccccggaacgcccccggggagauccugugguccgcgccccugggcccggaccucaaccccuaccugucccaccuggcccgcauguacaacggcuacgccgggggcuucgagguccaggugauccucgccgagaacgccuucaccgccgggaagaucaucuucgccgccgugccgcccaacuucccgacggagggccugagccccucccgggugaccauguucccccacaucaucguggacguccgccagcuggagcccgugcucaucccgcugcccgacgugcggaacaacuucuaccacuacaaccagagcaacgacuccaccaucaagcugaucgcgaugcucuacacgccccugcgcgccaacaacgccggggaggacgucuucaccgugagcugccgggugcugacccgccccuccccggacuucgacuucaucuuccucgucccgcccaccguggagagccggaccaagcccuucacggugcccauccugaccgucgaggagaccaccaacucccgcuuccccaucccccuggagaagcuguucacgggccccagcuccgccuucguggugcagccgcagaacggccggugcaccaccgacgggguccugcugggcaccacgcagcucagccccgugaacaucugcaccuuccgcggggacgucacccacaucgccggcucccggaacuacaccaugaaccuggcgagccugaacuggaacaacuacgugcccacggaggagaucccggcgccccucggcacccccgacuucguggggaagguccagggcaugcugacccagaccacgaagggggacggcuccacccgcgggcacaaggccaccguguacaccggcagcgcccccuucacgccgaagcugggcagcgugcaguucgagaccgacaccgagaacgacuucgagacccaccagaacacgaaguucacccccgucggggugauccaggacggcgggaccacccaccggaacgagccccagcagugggugcuccccuccuacagcggccgcaacgucccgaacgugcaccuggcccccgccguggcccccacguuccccggggagcagcuccucuucuuccgguccaccaugccgggcugcagcggcuaccccaacauggaccuggacugccugcucccccaggaguggguccagcacuucuaccaggaggccgcccccgcgcaguccgacguggcccugcugcgcuucgugaacccggacaccgggcggguccucuucgagugcaagcugcacaagagcggcuacgugaccguggcccacaccgggcagcacgaccuggucaucccgcccaacggcuacuuccgcuucgacuccugggugaaccaguucuacacgcucgcccccauggggaacggcaccggccggcgccgcgcccuguga

SEQ ID NO: 9462 - RNA, 1623 nt, Artificial Sequence
  derived and/or modified sequence opt1 from VP1__Norovirus__AGK25908
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccacggugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccgcaacuacaccaugaaccuggccagccugaacuggaacaacuacgaccccacggaggagaucccggcgccccucgggacccccgacuucgugggcaagauccaggggguccugacccagaccacgaagggcgacggguccacccggggccacaaggccaccguguacaccggcagcgcccccuucacgccgaagcuggggagcgugcaguucgagaccgacaccgagaacgacuucgagacccaccagaacacgaaguucacccccgucggcgugauccaggacgggggcaccacccaccgcaacgagccccagcagugggugcuccccuccuacagcgggcggaacgucccgaacgugcaccuggcccccgccguggcccccacguuccccggcgagcagcuccucuucuuccgcuccaccaugccgggcugcagcggguaccccaacauggaccuggacugccugcucccccaggaguggguccagcacuucuaccaggaggcggcccccgcccaguccgacguggcccugcugcgguucgugaacccggacaccggccgcguccucuucgagugcaagcugcacaagagcggguacgugaccguggcgcacaccggccagcacgaccuggucaucccgcccaacggguacuuccgguucgacuccugggugaaccaguucuacacgcucgcccccaugggcaacggcaccgggcgccggcgcgcccuguga

SEQ ID NO: 9463 - RNA, 1623 nt, Artificial Sequence
  derived and/or modified sequence opt1 from VP1__Norovirus__AGK25910
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugcccuccaacuuccccacggaggggcugagcccgucccaggucaccauguucccccacaucaucguggacgugcggcagcuggagcccguccucaucccccugccggacgugcgcaacaacuucuaccacuacaaccagagcaacgacuccaccaucaagcugaucgccaugcucuacacccugcugcgggcgaacaacgccggcgacgacguguucacggucagcugccgcgugcucacccggcccucccccgacuucgacuucaucuuccuggugcccccgaccgucgagagccgcaccaagcccuucuccgugcccgugcugacggucgaggagaugaccaacagccgguuccccaucccgcucgagaagcuguucaccggccccuccagcgccuucgugguccagccccagaacgggcgcugcaccacggacggcgugcugcucgggaccacccagcugucccccgugaacaucugcaccuuccggggcgacgucacgcacaucaccggcagccgcaacuacaccaugaaccuggccagccagaacuggaacaacuacgacccgaccgaggagauccccgcgccccucgggacgccggacuucgugggcaagauccaggggaugcugacccagaccacccggacggacggcuccacccgcgggcacaaggccaccauguacaccggcagcgccgacuucgcccccaagcugggccgggugcaguucgagacggacaccgaccacgacuucgaggccaaccagaacaccaaguucacccccgucggggugauccaggacggcgggacgacccaccgcaacgagccccagcagugggugcucccguccuacagcggccggaacacccacaacguccaccuggcccccgcgguggcccccaccuuccccggggagcagcuccucuucuuccgcccgacgaugcccggcugcuccggcuaccccaacauggaccuggaccggcugcucccccaggagugggugcaguacuucuaccaggaggccgccccggcgcagagcgacgucgcccugcugcgcuucgugaaccccgacaccgggcgggugcuguucgagugcaagcugcacaaguccggcuacgucaccguggcccacaccgggcagcacgaccuggugaucccgcccaacggcuacuuccgcuucgacagcugggucaaccaguucuacacccucgccccgauggggaacggcacgggccgccggcgcgugguguga

SEQ ID NO: 9464 - RNA, 1623 nt, Artificial Sequence
  derived and/or modified sequence opt1 from VP1__Norovirus__AGK25912
augaagauggccagcaacgacgccaaccccuccgacggcagcgcggccaaccuggugcccgaggucgacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgccccgcccaccguggagagccgcaccaagcccuucacggugcccauccugaccgucgaggagaugaccaacucccgguuccccaucccccuggagaagcuguucaccggccccagcuccgccuucguggugcagccgcagaacgggcgcugcacgaccgacggcguccugcuggggaccacccagcucagccccgugaacaucugcacguuccggggcgacgucacccacaucgccggcucccgcaacuacaccaugaaccuggcgagccugaacuggaacaacuacgaccccaccgaggagaucccggcgccccucgggacgcccgacuucgugggcaagauccaggggaugcugacccagaccaccaagggcgacggguccacgcggggccacaaggccaccguguacaccggcagcgcccccuucaccccgaagcuggggagcguccaguucgagacggacaccgagaacgacuucgagacccaccagaacaccaaguucacgcccgugggcgugauccaggacgggggcaccacccaccgcaacgagccccagcaguggguccuccccuccuacagcgggcggaacgugccgaacgugcaccuggcccccgccgucgcccccaccuuccccggcgagcagcuccucuucuuccgcuccacgaugccgggcugcagcggguaccccaacauggaccuggacugccugcucccccaggagugggugcagcacuucuaccaggaggccgcccccgcgcaguccgacguggcccugcugcgguucgucaacccggacaccggccgcguccucuucgagugcaagcugcacaagagcggguacgugaccguggcccacaccggccagcacgaccuggugaucccgcccaacggguacuuccgguucgacuccugggugaaccaguucuacacccucgcccccaugggcaacggcacggggcgccggcgcgcccuguga

SEQ ID NO: 9465 - RNA, 1623 nt, Artificial Sequence
  derived and/or modified sequence opt1 from VP1__Norovirus__AGK25915
augaagauggccagcaacgacgccaaccccuccgacggcagcgcggugaaccugguccccgaggugaacaacgaggugauggcccucgagcccgucgugggggccgccaucgccgcgcccguggccggccagcagaacgucaucgaccccuggauccgcaacaacuucgugcaggcccccgggggcgaguucaccgugagcccccggaacgcccccggggagauccugugguccgcgccccugggcccggaccucaaccccuaccugucccaccuggcccgcauguacaacggcuacgccgggggcuucgagguccaggugauccucgccgggaacgccuucaccgcgggcaagaucaucuucgccgccgugccgcccaacuucccgacggaggggcugagccccucccaggucaccauguucccccacaucaucguggacgcccggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacguggcccacaucgccggcucccgcaacuacaccaugaaccuggcgagccugaacuggaacaacuacgaccccaccgaggagaucccggcgccccucgggacccccgacuucgugggcaagauccaggggaugcugacgcagaccaccaagggcgacggguccacccggggccacaaggccacggucuacaccggcagcgcccccuucaccccgaagcuggggagcgugcaguucgagaccgacacggagaacgacuucgagacccaccagaacaccaaguucacccccgugggcgucauccaggacgggggcacgacccaccgcaacgagccccagcagugggugcuccccuccuacagcgggcggaacgugccgaacguccaccuggcccccgccguggcccccaccuuccccggcgagcagcugcuccuguuccgcuccaccaugccgggcugcagcggguaccccaacauggaccuggacugccuccugccccaggagugggugcagcacuucuaccaggaggccgcccccgcgcaguccgacgucgcccugcuccgguucgugaacccggacacgggccgcgugcuguucgagugcaagcugcacaagagcggguacgucaccguggcccacaccggccagcacgaccucgugaucccgcccuccggguacuuccgguucgacagcugggucaaccaguucuacacccuggcccccaugggcaacggcaccgggcgccggcgcgcccuguga

SEQ ID NO: 9466 - RNA, 1623 nt, Artificial Sequence
  derived and/or modified sequence opt1 from VP1__Norovirus__AGK25917
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacuccggcuuccccaucccccuggagaagcuguucaccgggcccagcuccgccuucgugguccagccgcagaacggccggugcacgaccgacggggugcugcugggcaccacccagcucagccccgucaacaucugcacguuccgcggcgacgugacccacaucgccgggucccggaacuacaccaugaaccuggccagccugaacuggaacaacuacgaccccaccgaggagaucccggcgccccucggcacgcccgacuucguggggaagguccagggcgugcugacccagaccaccaagggggacggcuccacgcgcggccacaaggccaccguguacaccgggagcgcccccuucaccccgaagcugggcagcguccaguucgagacggacaccgagaacgacuucgagacccaccagaacaccaaguucacgcccgugggggugauccaggacggcgggaccgcccaccggaacgagccccagcaguggguccuccccuccuacagcggccgcaacgugccgaacgugcaccuggcccccgcggucgcccccaccuuccccggcgagcagcuccucuucuuccgguccaccaugccggggugcagcggcuaccccaacauggaccuggacugccugcucccccaggagugggugcagcacuucuaccaggaggccgcccccgcgcaguccgacguggcccugcugcgcuucgucaacccggacacggggcggguccucuucgagugcaagcugcacaagagcggcuacgugaccguggcccacaccgggcagcgcgaccuggugaucccgcccaacggcuacuuccgguucgacuccugggugaaccaguucuacacccucgcccccaugggcaacgggaccggccgccggcgcgcccuguga

SEQ ID NO: 9467 - RNA, 1623 nt, Artificial Sequence
  derived and/or modified sequence opt1 from VP1__Norovirus__AGK25919
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagacgcccgcgccccuggggacccccgacuucgugggcaagauccaggggguccucacccagaccacgcggaccgacggcagcacccgcgggcacaaggccaccguguacacgggcagcgccgacuucgccccgaagcugggccgggugcaguucgagaccgacaccgaccacgacuucgaggccaaccagaacaccaaguucacgcccgucggggugauccaggacggcgggaccacccaccgcaacgagccccagcagugggugcugcccuccuacagcggccggaacacccacaacguccaccucgccccggcgguggcccccacguuccccggggagcagcugcuguucuuccgcuccaccaugcccggcugcagcggcuacccgaacauggaccucgacugccugcugccccaggagugggugcaguacuucuaccaggaggccgcccccgcgcacuccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacgcuggcccccauggggagcggcaccggccgccgccgggccguguga

SEQ ID NO: 9468 - RNA, 1623 nt, Artificial Sequence
  derived and/or modified sequence opt1 from VP1__Norovirus__AGK25921
augaagauggccagcuccgacgccaaccccagcgacggcuccgcggccaaccuggugccggaggucaacaacgaggugauggcccucgagcccguggccggggccgcgaucgccgcccccgucgccggccagcagaacgugaucgaccccuggauccgcaacaacuucgugcaggcgcccgggggcgaguucaccgucagcccccggaacgcccccggggagauccugugguccgcgccccugggcccggaccucaaccccuaccugagccaccuggcccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgcgaugcucuacgcgccccugcgggccaacaacgccggcgacgacguguucaccgucagcugccgcgugcugacgcggccgucccccgacuucgacuucaucuuccucgugccgcccaccgucgagagccgcaccaagcccuucuccgugcccgugcugaccgucgaggagaugacgaacagccgguuccccaucccccuggagaagcuguucaccggcccguccagcgccuucgugguccagccccagaacgggcgcugcaccaccgacggcgugcuccuggggacgacccagcucucccccgugaacaucugcaccuuccggggcgacgucacccacaucacgggcagccgcaacuacaccaugaaccuggccucccagaacuggaacaacuacgacccgaccgaggagauccccgcgccccuggggacccccgacuucgugggcaagauccagggggugcucacgcagaccacccggaccgacggcagcacgcgcgggcacaaggccaccgucuacaccggcagcgccgacuucgccccgaagcugggccgggugcaguucgagaccgacacggaccacgacuucgaggccaaccagaacaccaaguucacccccgugggggucauccaggacggcgggaccacgcaccgcaacgagccccagcagugggugcugcccuccuacagcggccggaacacccacaacgugcaccucgccccggccgucgcccccaccuuccccggggagcagcugcuguucuuccgcuccaccaugcccggcugcagcggcuacccgaacauggaccucgacugccugcugccccaggagugggugcaguacuucuaccaggaggcggcccccgcccaguccgacguggcccuccugcgguucgucaaccccgacacggggcgcgugcuguucgagugcaagcuccacaagagcggcuacgugaccgucgcccacaccgggcagcacgaccuggugaucccgcccaacggcuacuuccgguucgacuccugggugaaccaguucuacacccuggcgcccauggggaacggcaccggccgccgccgggccgucuga

SEQ ID NO: 9469 - RNA, 1623 nt, Artificial Sequence
  derived and/or modified sequence opt1 from VP1__Norovirus__AGK25924
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcucuccaccggcccgagcuccgccuucgucgugcagccccagaacgggcgcugcaccacggacggcgugcugcuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacacccacaacguccaccucgccccggcgguggcccccaccuuccccggggagcagcugcuguucuuccgcagcacgaugcccggcugcuccggcuacccgaacauggaccucgacugccugcugccccaggagugggugcaguacuucuaccaggaggccgcccccgcgcagagcgacgucgcccuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgggccguguga

SEQ ID NO: 9470 - RNA, 1623 nt, Artificial Sequence
  derived and/or modified sequence opt1 from VP1__Norovirus__AGK25927
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacgcgccccugcgggccaacaacgccggcgacgacgucuucaccgugagcugccgcgugcugacgcggccgucccccgacuucgacuucaucuuccucgucccgcccaccguggagagccgcaccaagcccuucuccgugcccguccugaccguggaggagaugacgaacagccgguuccccaucccccuggagaagcuguucaccggcccguccagcgccuucgucgugcagccccagaacgggcgcugcaccaccgacggcgugcuccuggggacgacccagcucucccccgucaacaucugcaccuuccggggcgacgugacccacaucacgggcagccgcaacuacaccaugaaccuggccucccagaacuggaacaacuacgacccgaccgaggagauccccgcgccccuggggacccccgacuucgugggcaagauccaggggguccucacgcagaccacccggaccgacggcagcacgcgcgggcacaaggccaccguguacaccggcagcgccgacuucgccccgaagcugggccgggugcaguucgagaccgacacggaccacgacuucgaggccaaccagaacaccaaguucacccccgucggggugauccaggacggcgggaccacgcaccgcaacgagccccagcagugggugcugcccuccuacagcggccggaacacccacaacguccaccucgcgccggccguggcccccaccuuccccggggagcagcugcuguucuuccgcuccaccaugcccggcugcagcggcuacccgaacauggaccucgacugccugcugccccaggagugggugcaguacuucuaccaggaggccgcgcccgcccaguccgacgucgcccuccugcgguucgugaaccccaacacggggcgcgugcuguucgagugcaagcuccacaagagcggcuacgucaccguggcccacaccgggcagcacgaccuggugaucccgcccaacgacuacuuccgguucgacuccugggucaaccaguucuacacccuggcccccaugggcaacgggaccggccgccgccgggcgguguga

SEQ ID NO: 9471 - RNA, 1623 nt, Artificial Sequence
  derived and/or modified sequence opt1 from VP1__Norovirus__AGK25930
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugggcaacaacuucuaccacuacaaccaguccaacgaccccaccaucaagcugaucgccaugcucuacacgccccugcgcgcgaacaacgccggcgacgacgucuucaccgugagcugccgggugcugacccgcccgucccccgacuucgacuucaucuuccucgucccgcccaccguggagagccggaccaagcccuucuccgugcccguccugacgguggaggagaugaccaacagccgcuuccccaucccccuggagaagcuguucaccgggccguccagcgccuucgucgugcagccccagaacggccggugcaccacggacggggugcuccugggcaccacccagcucucccccgucaacaucugcaccuuccgcggcgacgugacgcacaucaccgggagccggaacuacaccaugaaccuggccucccagaacuggaacaacuacgacccgaccgaggagauccccgcgccccugggcacgcccgacuucguggggaagauccagggcguccucacccagaccacccgcacggacgggagcacccggggccacaaggccaccguguacaccggcagcgccgacuucgccccgaagcuggggcgcgugcaguucgagacggacaccgaccacgacuucgaggccaaccagaacaccaaguucacccccgucggcgugauccaggacgggggcacgacccaccggaacgagccccagcagugggugcugcccuccuacagcgggcgcaacacccacaacguccaccucgccccggcgguggcccccaccuuccccggcgagcagcugcuguucuuccgguccacgaugcccggcugcagcggguacccgaacauggaccucgacugccugcugccccaggagugggugcaguacuucuaccaggaggccgcccccgcgcaguccgacgucgcccuccugcgcuucgugaaccccgacaccggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacggcacggggcggcgccgcgccguguga

SEQ ID NO: 9472 - RNA, 1623 nt, Artificial Sequence
  derived and/or modified sequence opt1 from VP1__Norovirus__AGS08025
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccaccaagacgaacggcagcacccgggggcacaaggccaccguguacaccggcuccgccgacuucagccccaagcugggccgcguccaguucgccacggacaccgacaacgacuucgagaccaaccagaacaccaaguucacgcccgugggggugauccaggacggcuccaccacgccccggaacgagccgcagcaguggguccugcccagcuacuccgggcgcaacauccacaacgugcaccucgcccccgccguggcccccaccuucccgggcgagcagcugcuguucuuccggagcaccaugcccgggugcuccggcuaccccaacauggaccucgacugccugcugccccaggaguggguccaguacuucuaccaggaggcggccccggcccagagcgacguggcccuccugcgcuucgugaaccccgacaccggccggguccuguucgagugcaagcuccacaaguccggguacgugaccguggcgcacaccggccagcacgaccuggucaucccgcccaacggguacuuccgcuucgacagcugggugaaccaguucuacacccuggcccccaugggcaacgggacgggccggcgccgcgcccucuga

SEQ ID NO: 9473 - RNA, 1623 nt, Artificial Sequence; identical to SEQ ID NO: 9034
  derived and/or modified sequence opt1 from VP1__Norovirus__AGS08026

SEQ ID NO: 9474 - RNA, 1623 nt, Artificial Sequence
  derived and/or modified sequence opt1 from VP1__Norovirus__AGS08027
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacauccccggcucccacaacuacaccaugaaccuggccagccagaacuggaacagcuacgacccgaccgaggagauccccgcgccccuggggacgcccgacuucgugggcaagauccaggggguccucacccagaccaccuccgccaacggcagcacgcgcgggcacaaggccaccguguacaccggcuccgccgacuucagcccgaagcugggccgggugcaguucgccaccgacacgaacaacgacuucgagaccaaccagaacaccaaguucacccccgucggggugauccaggacggcaacacgacgccccgcaacgagccccagcagugggugcugccguccuacagcgggcggaacauccacaacguccaccucgcccccgccguggcgcccaccuuccccggcgagcagcugcuguucuuccgcuccaccaugccggggugcagcggcuaccccaacauggaccucgacugccugcugccccaggagugggugcaguacuucuaccaggaggccgcccccgcccaguccgacgucgcgcuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccggcgcgcccucuga

SEQ ID NO: 9475 - RNA, 1623 nt, Artificial Sequence
  derived and/or modified sequence opt1 from VP1__Norovirus__AGS08028
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggagaccgcccccgcccaguccgacgucgcgcuccugcgguucgugaaccccgacaccgggcgcgugcuguucgagugcaagcuccacaagagcugcuacgucaccguggcccacaccggccagcacgaccuggugaucccgcccaacggguacuuccgguucgacuccugggucaaccaguucuacacgcuggcccccaugggcaacgggaccggccgccgccgggccguguga

SEQ ID NO: 9476 - RNA, 1623 nt, Artificial Sequence; identical to SEQ ID NO: 8882
  derived and/or modified sequence opt1 from VP1__Norovirus__AGS08029

SEQ ID NO: 9477 - RNA, 1623 nt, Artificial Sequence; identical to SEQ ID NO: 8882
  derived and/or modified sequence opt1 from VP1__Norovirus__AGS08030

SEQ ID NO: 9478 - RNA, 1623 nt, Artificial Sequence; identical to SEQ ID NO: 8882
  derived and/or modified sequence opt1 from VP1__Norovirus__AGS08031

SEQ ID NO: 9479 - RNA, 1623 nt, Artificial Sequence; identical to SEQ ID NO: 8842
  derived and/or modified sequence opt1 from VP1__Norovirus__AGS08032

SEQ ID NO: 9480 - RNA, 1623 nt, Artificial Sequence
  derived and/or modified sequence opt1 from VP1__Norovirus__AGS08033
augaagauggccagcuccgacgccaaccccagcgacggcuccguggcgaaccuggucccggaggugaacaacgaggugauggcccucgagcccgucgugggggccgccaucgccgcgcccguggccggccagcagaacgucaucgaccccuggauccgcaacaacuucgugcaggcccccgggggcgaguucaccgugagcccccggaacgcccccggggagauccugugguccgcgccccugggcccggaccucaaccccuaccugagccaccuggcccgcauguacaacggcuacgccgggggcuucgagguccaggugauccucgccgggaacgccuucaccgcgggcaaggugaucuucgccgccgucccgcccaacuucccgacggaggggcugucccccagccaggugaccauguucccccacaucguggucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcaccaagcccuucuccguccccgugcugacggucgaggagaugaccaacagccgguuccccaucccccuggagaagcuguucaccggcccguccagcgccuucguggugcagccccagaacgggcgcugcaccacggacggcguccuccuggggaccacccagcucucccccgugaacaucugcaccuuccggggcgacgugacgcacaucaccggcagccgcaacuacaccaugaaccuggccucccagaacuggaacaacuacgacccgaccgaggagauccccgcgccccuggggacgcccgacuucgucggcaagauccagggggugcucacccagaccacccggacggacggcagcacccgcgggcacaaggccaccguguacaccggcagcgccgacuucgccccgaagcugggccggguccaguucgagacggacaccgaccacgacuucgaggccaaccagaacaccaaguucacccccgugggggugauccaggacggcgggacgacccaccgcaacgagccccagcaguggguccugcccuccuacagcggccggaacacccacaacgugcaccucgccccggccguggcgcccaccuuccccggggagcagcugcuguucuuccgcuccacgaugcccggcugcagcggcuacccgaacauggaccucgacugccugcugccccaggaguggguccaguacuucuaccaggaggccgcccccgcccaguccgacguggcgcuccugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacccuggcccccauggggaacggcacgggccgccgccgggccguguga

SEQ ID NO: 9481 - RNA, 1623 nt, Artificial Sequence
  derived and/or modified sequence opt1 from VP1__Norovirus__AGS08035
augaagauggccagcuccgacgccaaccccagcgacggcuccaccgcgagccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacagcuacgccggcggguucgaggugcaggucauccucgccggcaacgccuucacggcggggaagaucaucuucgccgccgugccgcccaacuucccgaccgagggccugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggggacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacggccgcugcacgaccgacgggguccuccugggcaccacccagcucucccccgugaacaucugcacguuccgcggggacgugacccacaucagcggcagccacaacuacaccaugaaccuggccucccagaacuggaacagcuacgacccgaccgaggagauccccgcgccccugggcacgcccgacuucgucgggaagauccagggcgugcucacccagaccacccggaucaacggguccacgcggggccacaaggccaccguguacaccgggagcgccgacuucuccccgaagcugggccgcguccaguucgccaccgacacggacaacgacuucgagaccaaccagaacaccaaguucacccccgugggcgugauccaggacgggagcacgacgccccggaacgagccccagcaguggguccugccguccuacagcggccgcaacacccacaacgugcaccucgcccccgccguggcccccaccuuccccggggagcagcugcuguucuuccgguccaccaugccgggcugcagcggguaccccaacauggaccucgacugccugcugccccaggaguggguccaguacuucuaccaggaggcggcccccgcccaguccgacguggcccuccugcgcuucgugaacccggacaccggccggguccuguucgagugcaagcuccacaagagcggcuacgugaccguggcgcacaccgggcagcacgaccuggucaucccgcccaacggcuacuuccgcuucgacuccugggugaaccaguucuacacccuggcccccauggggaacggcacggggcggcgccgcgcccucuga

SEQ ID NO: 9482 - RNA, 1623 nt, Artificial Sequence; identical to SEQ ID NO: 9034
  derived and/or modified sequence opt1 from VP1__Norovirus__AGS08036

SEQ ID NO: 9483 - RNA, 1623 nt, Artificial Sequence; identical to SEQ ID NO: 8882
  derived and/or modified sequence opt1 from VP1__Norovirus__AGS08037

SEQ ID NO: 9484 - RNA, 1623 nt, Artificial Sequence
  derived and/or modified sequence opt1 from VP1__Norovirus__AGS08038
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgacgccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgggccguguga

SEQ ID NO: 9485 - RNA, 1623 nt, Artificial Sequence; identical to SEQ ID NO: 8882
  derived and/or modified sequence opt1 from VP1__Norovirus__AGS08040

SEQ ID NO: 9486 - RNA, 1623 nt, Artificial Sequence; identical to SEQ ID NO: 9034
  derived and/or modified sequence opt1 from VP1__Norovirus__AGS08041

SEQ ID NO: 9487 - RNA, 1623 nt, Artificial Sequence; identical to SEQ ID NO: 8842
  derived and/or modified sequence opt1 from VP1__Norovirus__AGS08042

SEQ ID NO: 9488 - RNA, 1623 nt, Artificial Sequence
  derived and/or modified sequence opt1 from VP1__Norovirus__AGS08043
augaagauggccagcuccgacgccaaccccagcgacggcuccaccgcgaaccuggugcccgaggucagcaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacagcgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacauccccggcagccacaacuacaccaugaaccuggccucccagaacuggaacagcuacgacccgaccgaggagauccccgcgccccuggggacgcccgacuucgugggcaagauccaggggguccucacccagaccaccuccacgaacggcagcacccgcgggcacaaggccaccguguacaccggcuccgccgacuucagcccgaagcugggccgggugcaguucgccacggacaccaacaacgacuucgagaccaaccagaacaccaaguucacgcccgucggggugauccaggacggcuccaccacgccccgcaacgagccccagcagugggugcugccgagcuacuccgggcggaacauccacaacguccaccucgcccccgccguggcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacgucgcccuccugcgguucgugaacccggacaccggccgcgugcuguucgagugcaagcuccacaaguccggguacaucaccgucgcgcacaccggccagcacgaccuggugaucccgcccaacggguacuuccgguucgacagcugggugaaccaguucuacacccuggcccccaugggcaacgggacgggccgccggcgcgcccucuga

SEQ ID NO: 9489 - RNA, 1623 nt, Artificial Sequence
  derived and/or modified sequence opt1 from VP1__Norovirus__AGS08044
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacauccccggcucccacaacuacaccaugaaccuggccagccagaacuggaacagcuacgacccgaccgaggagauccccgcgccccuggggacgcccgacuucgugggcaagauccaggggguccucacccagaccaccuccacgaacggcagcacccgcgggcacaaggccaccguguacaccggcuccgccgacuucagcccgaagcugggccgggugcaguucgccacggacaccaacaacgacuucgagaccaaccagaacaccaaguucacgcccgucggggugauccaggacggcuccaccacgccccgcaacgagccccagcagugggugcugccgagcuacuccgggcggaacauccacaacguccaccucgcccccgccguggcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacgucgcccuccugcgguucgugaacccggacaccggccgcgugcuguucgagugcaagcuccacaaguccggguacgucaccguggcgcacaccggccagcacgaccuggugaucccgcccaacggguacuuccgguucgacagcugggucaaccaguucuacacccuggcccccaugggcaacgggacgggccgccggcgcgcccucuga

SEQ ID NO: 9490 - RNA, 1623 nt, Artificial Sequence
  derived and/or modified sequence opt1 from VP1__Norovirus__AGS08045
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccgucccccuggagaagcuguucaccggcccguccagcgccuucgugguccagccccagaacgggcgcugcacgaccgacggcgugcuccuggggaccacccagcucucccccgugaacaucugcacguuccggggcgacgucacccacaucaccggcagccgcaacuacaccaugaaccuggccucccagaacuggaacagcuacgacccgacggaggagauccccgcgccccuggggacccccgacuucgugggcaagauccagggggugcucacccagaccacgcggaccaacggcagcacccgcgggcacaaggccaccgucuacacgggcuccgccgacuucagcccgaagcugggccgggugcaguucgccaccgacaccgacaacgacuucgagaccaaccagaacacgaaguucacccccgugggggucauccaggacggcuccaccacgccccgcaacgagccccagcagugggugcugccgagcuacuccgggcggaacauccacaacgugcaccucgcccccgccgucgcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggguacgugaccgucgcgcacaccggccagcacgaccuggugaucccgcccaacggguacuuccgguucgacagcugggugaaccaguucuacacgcuggcccccaugggcaacgggaccggccgccgccgggcccucuga

SEQ ID NO: 9491 - RNA, 1623 nt, Artificial Sequence
  derived and/or modified sequence opt1 from VP1__Norovirus__AGS08047
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacggccgcugcacgaccgacgggguccuccugggcaccacccagcucagccccgugaacaucugcacguuccgcggggacgugacccacaucuccggcagccggaacuacaccaugaaccuggccagccagaacuggaacuccuacgacccgaccgaggagauccccgcgccccugggcacgcccgacuucgucgggaagauccagggcgugcucacccagaccacccggacggacgggagcacccgcggccacaaggccaccguguacaccggguccgccgacuucagcccgaagcugggccggguccaguucgccacggacaccgacaacgacuucgugaccaaccagaacaccaaguucacgcccgugggcgucauccaggacggguccaccacgccccgcaacgagccccagcagugggugcugccgagcuacuccggccggaacacccacaacgugcaccucgcccccgccgucgcccccaccuuccccggggagcagcugcuguucuuccgcagcaccaugccgggcugcuccggguaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggcuacgugaccgucgcgcacaccgggcagcacgaccuggugaucccgcccaacggcuacuuccgguucgacagcugggugaaccaguucuacacgcuggcccccauggggaacggcaccgggcgccgccgggcccucuga

SEQ ID NO: 9492 - RNA, 1623 nt, Artificial Sequence; identical to SEQ ID NO: 9034
  derived and/or modified sequence opt1 from VP1__Norovirus__AGS08048

SEQ ID NO: 9493 - RNA, 1623 nt, Artificial Sequence
  derived and/or modified sequence opt1 from VP1__Norovirus__AGS08050
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcagcacgacccaccgcaacgagccccagcagugggugcugcccuccuacagcgggcggaacaccccgaacguccaccucgcccccgcgguggcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacgucgcccuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgggcccucuga

SEQ ID NO: 9494 - RNA, 1623 nt, Artificial Sequence
  derived and/or modified sequence opt1 from VP1__Norovirus__AGS08051
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcgccuuccggggcgacgugacgcacaucagcggcucccgcaacuacaccaugaaccuggccagccagaacuggaacagcuacgacccgaccgaggagauccccgcgccccuggggacccccgacuucgucggcaagauccaggggaugcucacgcagaccacccggaccgacggcuccacgcgcgggcacaaggccaccguguacaccggcagcgccgacuucuccccgaagcugggccgggugcaguucgccaccgacacggacaacgacuucgucaccaaccagaacaccaaguucacccccgugggggugauccaggacggcagcacgacgccccgcaacgagccccagcaguggguccugccguccuacagcgggcggaacacccacaacgugcaccucgcccccgccguggcgcccaccuuccccggcgagcagcugcuguucuuccgcuccaccaugccggggugcagcggcuaccccaacauggaccucgacugccugcugccccaggaguggguccaguacuucuaccaggaggccgcccccgcccaguccgacguggcgcuccugcgguucgugaacccggacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccgggcccucuga

SEQ ID NO: 9495 - RNA, 1623 nt, Artificial Sequence
  derived and/or modified sequence opt1 from VP1__Norovirus__AGS08052
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgggacggacaccgaccacgacuucgaggccaaccagaacaccaaguucacccccgucggcgugauccaggacgggagcacgacccaccgcaacgagccccagcagugggugcugcccuccuacagcggccggaacaccccgaacguccaccucgcccccgcgguggcccccaccuuccccggggagcagcugcuguucuuccgcuccacgaugccgggcugcagcggcuaccccaacauggaccucgacugccugcugccccaggagugggugcaguacuucuaccaggaggccgcccccgcgcaguccgacgucgcccuccugcgguucgugaacccggacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgggcccucuga

SEQ ID NO: 9496 - RNA, 1623 nt, Artificial Sequence
  derived and/or modified sequence opt1 from VP1__Norovirus__AGS08054
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucguggccgaccagaacaccaaguucacccccgugggggucauccaggacggcagcacgacgccccgcaacgagccccagcagugggugcugccguccuacagcgggcggaacacccacaacgugcaccucgcccccgccgucgcgcccaccuuccccggcgagcagcugcuguucuuccgcuccaccaugccggggugcagcggcuaccccaacauggaccucgacugccugcugccccaggagugggugcaguacuucuaccaggaggccgcccccgcccaguccgacguggcgcuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgggcccucuga

SEQ ID NO: 9497 - RNA, 1623 nt, Artificial Sequence
  derived and/or modified sequence opt1 from VP1__Norovirus__AGS08056
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcgggacgacccaccggaacgagccccagcagugggugcugcccagcuacuccggccgcaacaccccgaacguccaccucgcccccgcgguggcccccaccuuccccggggagcagcugcuguucuuccggagcacgaugccgggcugcuccggcuaccccaacauggaccucgacugccugcugccccaggagugggugcaguacuucuaccaggaggccgcccccgcgcagagcgacgucgcccuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacccuggcccccauggggaacggcacgggccgccggcgcgcccucuga

SEQ ID NO: 9498 - RNA, 1623 nt, Artificial Sequence
  derived and/or modified sequence opt1 from VP1__Norovirus__AGS08057
augaagauggccagcuccgacgcccaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccgggccgacggcuccacgcgcgggcacaaggccaccguguacaccggcagcgccgacuucuccccgaagcugggccggguccaguucgccaccgacacggacaacgacuucguggccaaccagaacaccaaguucacccccgugggggucauccaggacggcagcaccacgccccgcaacgagccccagcagugggugcugccguccuacagcgggcggaacacccacaacgugcaccucgcccccgcggucgcccccaccuuccccggcgagcagcugcuguucuuccgcuccaccaugccggggugcagcggcuaccccaacauggaccucgacugccugcugccccaggagugggugcaguacuucuaccaggaggccgcccccgcgcaguccgacguggcccuccugcgguucgucaacccggacacgggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggaccggccgccgccgggcccucuga

SEQ ID NO: 9499 - RNA, 1623 nt, Artificial Sequence
  derived and/or modified sequence opt1 from VP1__Norovirus__AGS08058
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgggccguguga

SEQ ID NO: 9500 - RNA, 1623 nt, Artificial Sequence
  derived and/or modified sequence opt1 from VP1__Norovirus__AGS08059
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccuguggaacgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacacccacaacguccaccucgccccggcgguggcccccaccuuccccggggagcagcugcuguucuuccgcagcacgaugcccggcugcuccggcuacccgaacauggaccucgacugccugcugccccaggagugggugcaguacuucuaccaggaggccgcccccgcgcagagcgacgucgcccuccugcgguucgugaaccccgacaccgggcgcgugcuguucgagugcaagcuccacaaguccggcuacgccaccgucgcccacaccgggcagcacgaccuggugaucccgcccaacggcuacuuccgguucgacagcugggugaaccaguucuacacccuggcccccauggggaacggcacgggccgccgccgggcggucuga

SEQ ID NO: 9501 - RNA, 1623 nt, Artificial Sequence
  derived and/or modified sequence opt1 from VP1__Norovirus__AGS08060
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacaccccgaacguccaccucgcccccgcgguggcccccaccuuccccggggagcagcugcuguucuuccgcuccacgaugccgggcugcagcggcuaccccaacauggaccucgacugccugcugccccaggagugggugcaguacuucuaccaggaggccgcccccgcgcaguccgacgucgcccuccugcgguucgugaacccggacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgggcccucuga

SEQ ID NO: 9502 - RNA, 1623 nt, Artificial Sequence; identical to SEQ ID NO: 8842
  derived and/or modified sequence opt1 from VP1__Norovirus__AGS08061

SEQ ID NO: 9503 - RNA, 1623 nt, Artificial Sequence; identical to SEQ ID NO: 9497
  derived and/or modified sequence opt1 from VP1__Norovirus__AGS08062

SEQ ID NO: 9504 - RNA, 1623 nt, Artificial Sequence; identical to SEQ ID NO: 9489
  derived and/or modified sequence opt1 from VP1__Norovirus__AGS08063

SEQ ID NO: 9505 - RNA, 1623 nt, Artificial Sequence; identical to SEQ ID NO: 9034
  derived and/or modified sequence opt1 from VP1__Norovirus__AGS08064

SEQ ID NO: 9506 - RNA, 1623 nt, Artificial Sequence; identical to SEQ ID NO: 8882
  derived and/or modified sequence opt1 from VP1__Norovirus__AGS08065

SEQ ID NO: 9507 - RNA, 1623 nt, Artificial Sequence; identical to SEQ ID NO: 9489
  derived and/or modified sequence opt1 from VP1__Norovirus__AGS08066

SEQ ID NO: 9508 - RNA, 1623 nt, Artificial Sequence; identical to SEQ ID NO: 9034
  derived and/or modified sequence opt1 from VP1__Norovirus__AGS08067

SEQ ID NO: 9509 - RNA, 1623 nt, Artificial Sequence
  derived and/or modified sequence opt1 from VP1__Norovirus__AGS08068
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccagcgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgacccgaccgaggagauccccgcgccccuggggacgcccgacuucgucggcaagauccagggggugcucacccagaccacccggacggacggcagcacccgcgggcacaaggccaccguguacaccggcuccgccgacuucagcccgaagcugggccggguccaguucgccacggacaccgacaacgacuucgugaccaaccagaacaccaaguucacgcccgugggggucauccaggacggcuccaccacgccccgcaacgagccccagcagugggugcugccgagcuacuccgggcggaacacccacaacgugcaccucgcccccgccgucgcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggguacgugaccgucgcgcacaccggccagcacgaccuggugaucccgcccaacggguacuuccgguucgacagcugggugaaccaguucuacacgcuggcccccaugggcaacgggaccggccgccgccgggcccucuga

SEQ ID NO: 9510 - RNA, 1623 nt, Artificial Sequence
  derived and/or modified sequence opt1 from VP1__Norovirus__AGS08069
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacacccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacgcuggcccccaugggcaacgggaccggccgccgccgggcccucuga

SEQ ID NO: 9511 - RNA, 1623 nt, Artificial Sequence
  derived and/or modified sequence opt1 from VP1__Norovirus__AGS08070
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucggggugcaggucauccucgccggcaacgccuucaccgccgggaaggugaucuucgccgccgugccgcccaacuucccgacggagggccugucccccagccaggucaccauguucccccacaucguggugaacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccgggccguccagcgccuucgucgugcagccccagaacggccgcugcaccacggacggggugcuccugggcaccacccagcucucccccgucaacaucugcaccuuccggggcgacgugacgcacaucaccgggagccgcaacuacaccaugaaccuggccucccagaacuggaacaacuacgacccgaccgaggagacgcccgcgccccugggcacccccgacuucguggggaagauccagggcguccucacccagaccacgcggaccgacgggagcacccgcggccacaaggccaccguguacacgggcagcgccgacuucgccccgaagcuggggcgggugcaguucgagaccgacaccgaccacgacuucgaggccaaccagaacaccaaguucacgcccgucggcgugauccaggacggguccaccacccaccgcaacgagccccagcagugggugcugcccagcuacuccggccggaacacccacaacguccaccucgccccggcgguggcccccacguuccccggggagcagcugcuguucuuccgcagcaccaugcccggcugcuccggcuacccgaacauggaccucgacugccugcugccccaggagugggugcaguacuucuaccaggaggccgcccccgcgcagagcgacgucgcccuccugcgguucgugaaccccgacaccgggcgcgugcuguucgagugcaagcuccacaaguccggcuacgucaccguggcccugaccgggcagcacgaccuggugaucccgcccaacggcuacuuccgguucgacagcugggucaaccaguucuacacgcucgcccccauggggaacggcaccggccgccgccgggccguguga

SEQ ID NO: 9512 - RNA, 1623 nt, Artificial Sequence; identical to SEQ ID NO: 9497
  derived and/or modified sequence opt1 from VP1__Norovirus__AGS08071

SEQ ID NO: 9513 - RNA, 1623 nt, Artificial Sequence; identical to SEQ ID NO: 8882
  derived and/or modified sequence opt1 from VP1__Norovirus__AGS08072

SEQ ID NO: 9514 - RNA, 1623 nt, Artificial Sequence; identical to SEQ ID NO: 9405
  derived and/or modified sequence opt1 from VP1__Norovirus__AGS08073

SEQ ID NO: 9515 - RNA, 1623 nt, Artificial Sequence; identical to SEQ ID NO: 9489
  derived and/or modified sequence opt1 from VP1__Norovirus__AGS08074

SEQ ID NO: 9516 - RNA, 1623 nt, Artificial Sequence; identical to SEQ ID NO: 9034
  derived and/or modified sequence opt1 from VP1__Norovirus__AGS08076

SEQ ID NO: 9517 - RNA, 1623 nt, Artificial Sequence; identical to SEQ ID NO: 9034
  derived and/or modified sequence opt1 from VP1__Norovirus__AGS08079

SEQ ID NO: 9518 - RNA, 1623 nt, Artificial Sequence; identical to SEQ ID NO: 9489
  derived and/or modified sequence opt1 from VP1__Norovirus__AGS08080

SEQ ID NO: 9519 - RNA, 1623 nt, Artificial Sequence
  derived and/or modified sequence opt1 from VP1__Norovirus__AGS08081
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacauccccggcucccacaacuacaccaugaaccuggccagccagaacuggaacagcuacgacccgaccgaggagauccccgcgccccuggggacgcccgacuucgugggcaagauccaggggguccucacccagaccaccuccacgaacggcagcacccgcgggcacaaggccaccguguacaccggcuccgccgacuucagcccgaagcugggccgggugcaguucgucacggacaccaacaacgacuucgagaccaaccagaacaccaaguucacgcccgugggggugauccaggacggcuccaccacgccccgcaacgagccccagcaguggguccugccgagcuacuccgggcggaacauccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggccgcgcccgcccagagcgacguggcccuccugcgguucgugaacccggacaccggccgcguccuguucgagugcaagcuccacaaguccggguacgugaccguggcccacaccggccagcacgaccuggucaucccgcccaacggguacuuccgguucgacagcugggugaaccaguucuacacccuggcgcccaugggcaacgggacgggccgccggcgcgcccucuga

SEQ ID NO: 9520 - RNA, 1623 nt, Artificial Sequence
  derived and/or modified sequence opt1 from VP1__Norovirus__AGS08082
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucacgccgaagcugggccggguccaguucgccaccgacaccgacaacgacuucgugaccaaccagaacacgaaguucacccccgugggggucauccaggacggcuccaccacgccccgcaacgagccccagcagugggugcugccgagcuacuccgggcggaacacccacaacgugcaccucgcccccgccgucgcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggguacgugaccgucgcgcacacgggccagcacgaccuggugaucccgcccaacggguacuuccgguucgacagcugggugaaccaguucuacacccuggcccccaugggcaacgggaccggccgccgccgggcccucuga

SEQ ID NO: 9521 - RNA, 1623 nt, Artificial Sequence; identical to SEQ ID NO: 9034
  derived and/or modified sequence opt1 from VP1__Norovirus__AGS08083

SEQ ID NO: 9522 - RNA, 1623 nt, Artificial Sequence
  derived and/or modified sequence opt1 from VP1__Norovirus__AGS08084
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccuacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccacaacuacaccaugaaccuggccucccagaacuggaacagcuacgaccccaccgaggagauccccgcgccccuggggacgccggacuucgucggcaagauccagggggugcucacccagaccaccaagacgaacggcagcacccgcgggcacaaggccaccguguacaccggcuccgccgacuucagccccaagcugggccggguccaguucgccacggacaccaacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcguacaccggccagcacgaccuggucaucccgcccaacggguacuuccgguucgacagcugggugaaccaguucuacacccuggcccccaugggcaacgggacgggccgccggcgcgcccucuga

SEQ ID NO: 9523 - RNA, 1623 nt, Artificial Sequence
  derived and/or modified sequence opt1 from VP1__Norovirus__AGS08085
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgccaccgucgcccacaccgggcagcacgaccuggugaucccgcccaacggcuacuuccgguucgacuccugggugaaccaguucuacacccuggcccccauggggaacggcacgggccgccgccgggcggucuga

SEQ ID NO: 9524 - RNA, 1623 nt, Artificial Sequence; identical to SEQ ID NO: 9489
  derived and/or modified sequence opt1 from VP1__Norovirus__AGS08086

SEQ ID NO: 9525 - RNA, 1623 nt, Artificial Sequence
  derived and/or modified sequence opt1 from VP1__Norovirus__AGS08087
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccuccacgauccuguggagcgcgccccuggggccggaccucaaccccuaccugucccaccuggcccgcauguacaacggcuacgccggcggguucgaggugcaggucauccucgccggcaacgccuucaccgcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggggacgacguguucaccguguccugccgcguccugacccggccgagccccgacuucgacuucaucuuccucgugccgcccaccguggagucccgcaccaagcccuucagcguccccgugcugaccguggaggagaugaccaacucccgguuccccaucccccuggagaagcuguucacgggcccgagcuccgccuucgucgugcagccccagaacggccgcugcaccaccgacgggguccuccugggcaccacgcagcucagccccgugaacaucugcaccuuccgcggggacgugacccacaucuccggcagccggaacuacaccaugaaccuggccagccagaacuggaacuccuacgacccgacggaggagauccccgcgccccugggcacccccgacuucgucgggaagauccagggcgugcucacccagaccacgcggaccgacgggagcacccgcggccacaaggccaccguguacacgggguccgccgacuucagcccgaagcugggccggguccaguucgccaccgacaccgacaacgacuucgugaccaaccagaacacgaaguucacccccgugggcgucauccaggacggguccaccacgccccgcaacgagccccagcagugggugcugccgagcuacuccggccggaacauccacaacgugcaccucgcccccgccgucgcccccaccuuccccggggagcagcugcuguucuuccgcagcaccaugccgggcugcuccggguaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggcuacgugaccgucgcgcacaccgggcagcacgaccuggugaucccgcccaacggcuacuuccgguucgacagcugggugaaccaguucuacacgcuggcccccauggggaacggcaccgggcgccgccgggcccucuga

SEQ ID NO: 9526 - RNA, 1623 nt, Artificial Sequence; identical to SEQ ID NO: 9489
  derived and/or modified sequence opt1 from VP1__Norovirus__AGS08088

SEQ ID NO: 9527 - RNA, 1623 nt, Artificial Sequence; identical to SEQ ID NO: 8842
  derived and/or modified sequence opt1 from VP1__Norovirus__AGS08089

SEQ ID NO: 9528 - RNA, 1623 nt, Artificial Sequence; identical to SEQ ID NO: 9034
  derived and/or modified sequence opt1 from VP1__Norovirus__AGS08090

SEQ ID NO: 9529 - RNA, 1623 nt, Artificial Sequence
  derived and/or modified sequence opt1 from VP1__Norovirus__AGS08091
augaagauggccagcuccgacgccaaccccaccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcacgaagcccuucuccguccccgugcugaccguggaggagaugaccaacagccgguuccccaucccccuggagaagcuguucaccggccccuccagcgccuucgucgugcagccgcagaacgggcgcugcacgaccgacggcguccuccuggggaccacccagcucucccccgugaacaucugcacguuccggggcgacgugacccacaucaccggcagccgcaacuacaccaugaaccuggccucccagaacuggaacaacuacgaccccacggaggagaccccggcgccccuggggacccccgacuucgucggcaagauccaggggaugcucacccagacgacccggaccgacggcagcacccgcgggcacaaggccacgguguacaccggcagcgccgacuucgcccccaagcugggccgggugcaguucgagaccgacaccgaccacgacuucgaggccaaccagaacacgaaguucaccccggucggggugauccaggacggcuccaccacccaccgcaacgagccccagcagugggugcugcccagcuacuccgggcggaacacgcacaacguccaccucgcccccgcgguggccccgaccuuccccggcgagcagcugcuguucuuccgcagcaccaugcccgggugcuccggcuaccccaacauggaccucgacugccugcugccgcaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacacgggccagcacgaccuggugaucccgcccaacggguacuuccgguucgacagcugggucaaccaguucuacacccuggcccccaugggcaacgggaccggccgccgccgggugguguga

SEQ ID NO: 9530 - RNA, 1623 nt, Artificial Sequence; identical to SEQ ID NO: 9034
  derived and/or modified sequence opt1 from VP1__Norovirus__AGS08092

SEQ ID NO: 9531 - RNA, 1623 nt, Artificial Sequence; identical to SEQ ID NO: 9489
  derived and/or modified sequence opt1 from VP1__Norovirus__AGS08093

SEQ ID NO: 9532 - RNA, 1623 nt, Artificial Sequence; identical to SEQ ID NO: 8882
  derived and/or modified sequence opt1 from VP1__Norovirus__AGS08094

SEQ ID NO: 9533 - RNA, 1623 nt, Artificial Sequence; identical to SEQ ID NO: 8882
  derived and/or modified sequence opt1 from VP1__Norovirus__AGS08095

SEQ ID NO: 9534 - RNA, 1623 nt, Artificial Sequence; identical to SEQ ID NO: 9497
  derived and/or modified sequence opt1 from VP1__Norovirus__AGS08096

SEQ ID NO: 9535 - RNA, 1623 nt, Artificial Sequence
  derived and/or modified sequence opt1 from VP1__Norovirus__AGS08097
augaagauggccagcuccgacgccaaccccagcgacggcuccaccgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugggcccggaccucaaccccuaccugagccaccuggcccgcauguacaacggcuacgccgggggcuucgagguccaggugauccucgccgggaacgccuucacggcgggcaagaucaucuucgccgccgugccgcccaacuucccgaccgaggggcugucccccagccaggugaccauguucccccacaucaucguggacguccggcagcuggagcccgugcucaucccgcugcccgacgugcgcaacaacuucuaccacuacaaccaguccaacgacagcaccaucaagcugaucgccaugcucuacacgccccugcgggccaacaacgcgggcgacgacgucuucaccguguccugccgcgugcugacccggcccagcccggacuucgacuucaucuuccucgucccgcccaccguggagucccgcacgaagcccuucagcgugcccguccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucuccggcagccgcaacuacaccaugaaccuggccagccagaacuggaacuccuacgaccccaccgaggagaucccggcgccccuggggacgcccgacuucgugggcaagauccaggggguccucacccagaccacccggacggacggcagcacccgcgggcacaaggccaccguguacaccggcuccgccgacuucagccccaagcugggccgggugcaguucgccacggacaccgacaacgacuucgucaccaaccagaacaccaaguucacgccggugggggugauccaggacggcuccaccacgccccgcaacgagccccagcaguggguccugcccagcuacuccgggcggaacacccacaacgugcaccucgccccggccguggcccccaccuuccccggcgagcagcugcuguucuuccgcagcaccaugcccgggugcuccggcuacccgaacauggaccucgacugccugcugccccaggaguggguccaguacuucuaccaggaggcggcccccgcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacgcuggcccccaugggcaacgggaccggccgccgccgggcccucuga

SEQ ID NO: 9536 - RNA, 1623 nt, Artificial Sequence
  derived and/or modified sequence opt1 from VP1__Norovirus__AGS08098
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccacaacuacaccaugaaccuggccagccagaacuggaacagcuacgacccgaccgaggagauccccgcgccccuggggacgcccgacuucgucggcaagauccagggggugcucacccagaccacccgcacggacggcuccacccgggggcacaaggccaccguguacaccggcagcgccgacuucuccccgaagcugggccgcguccaguucgccacggacaccgacaacgacuucgugaccaaccagaacaccaaguucacgcccgugggggucauccaggacggcagcaccacgccccggaacgagccccagcagugggugcugccguccuacagcgggcgcaacacccacaacgugcaccucgcccccgccgucgcccccaccuuccccggcgagcagcugcuguucuuccgguccaccaugccggggugcagcggcuaccccaacauggaccucgacugccugcugccccaggagugggugcaguacuucuaccaggaggcggcccccgcccaguccgacguggcccuccugcgcuucgucaacccggacaccggccgggugcuguucgagugcaagcuccacaagagcggguacgugaccgucgcgcacaccggccagcacgaccuggugaucccgcccaacggguacuuccgcuucgacuccugggugaaccaguucuacacgcuggcccccaugggcaacgggaccggccggcgccgcgcccucuga

SEQ ID NO: 9537 - RNA, 1623 nt, Artificial Sequence; identical to SEQ ID NO: 9034
  derived and/or modified sequence opt1 from VP1__Norovirus__AGS08099

SEQ ID NO: 9538 - RNA, 1623 nt, Artificial Sequence
  derived and/or modified sequence opt1 from VP1__Norovirus__AGS08100
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggucagccagaacuggaacagcuacgacccgaccgaggagauccccgcgccccuggggacgcccgacuucgugggcaagauccagggggugcucacccagaccacccggacgaacggcuccacccgcgggcacaaggccaccgucuacaccggcagcgccgacuucuccccgaagcugggccgggugcaguucgccacggacaccgacaacgacuucgagaccaaccagaacaccaaguucacgcccgugggggucauccaggacggcagcaccacgccccgcaacgagccccagcagugggugcugccguccuacagcgggcggaacauccacaacgugcaccucgcccccgccgucgcccccaccuuccccggcgagcagcugcuguucuuccgcuccaccaugccggggugcagcggcuaccccaacauggaccucgacugccugcugccccaggagugggugcaguacuucuaccaggaggccgcgcccgcccaguccgacguggcccuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcgcccaugggcaacgggacgggccgccgccgggcccucuga

SEQ ID NO: 9539 - RNA, 1623 nt, Artificial Sequence
  derived and/or modified sequence opt1 from VP1__Norovirus__AGS08101
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucuccggcagccgcaacuacaccaugaaccuggccagccagaacuggaacuccuacgaccccaccgaggagaucccggcgccccuggggacccccgacuucgucggcaagauccagggggugcucacgcagaccacccggaccgacggcagcacgcgcgggcacaaggccaccguguacaccggcuccgccgacuucagccccaagcugggccggguccaguucgccaccgacacggacaacgacuucaucaccaaccagaacaccaaguucaccccggugggggugauccaggacggcuccacgacgccccgcaacgagccccagcaguggguccugcccagcuacuccgggcggaacacccacaacgugcaccucgccccggccguggcgcccaccuuccccggcgagcagcugcuguucuuccgcagcaccaugcccgggugcuccggcuacccgaacauggaccucgacugccugcugccccaggaguggguccaguacuucuaccaggaggccgcccccgcccagagcgacguggcgcuccugcgguucgugaaccccgacaccggccgcguccuguucgagugcaagcuccacaagccgggguacgugaccguggcccacaccggccagcacgaccuggucaucccgcccaacggguacuuccgguucgacuccugggugaaccaguucuacacccuggcccccaugggcaacgggacgggccgccgccgggcccucuga

SEQ ID NO: 9540 - RNA, 1623 nt, Artificial Sequence; identical to SEQ ID NO: 9445
  derived and/or modified sequence opt1 from VP1__Norovirus__AGS08102

SEQ ID NO: 9541 - RNA, 1623 nt, Artificial Sequence
  derived and/or modified sequence opt1 from VP1__Norovirus__AGS08103
augaagauggccagcuccgacgcccaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucgugaccaaccagaacaccaaguucacgcccgugggggucauccaggacggcagcaccacgccccgcaacgagccccagcagugggugcugccguccuacagcgggcggaacacccacaacgugcaccucgcccccgccgucgcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacguggcccuccugcgguucgucaacccggacaccggccgcgugcuguucgagugcaagcuccacaagagcggguacgugaccgucgcgcacaccggccagcacgaccuggugaucccgcccaacggguacuuccgguucgacuccugggugaaccaguucuacacgcuggcccccaugggcaacgggaccggccgccgccgggcccucuga

SEQ ID NO: 9542 - RNA, 1623 nt, Artificial Sequence; identical to SEQ ID NO: 9535
  derived and/or modified sequence opt1 from VP1__Norovirus__AGS08104

SEQ ID NO: 9543 - RNA, 1623 nt, Artificial Sequence; identical to SEQ ID NO: 9501
  derived and/or modified sequence opt1 from VP1__Norovirus__AGS08105

SEQ ID NO: 9544 - RNA, 1623 nt, Artificial Sequence; identical to SEQ ID NO: 9520
  derived and/or modified sequence opt1 from VP1__Norovirus__AGS08106

SEQ ID NO: 9545 - RNA, 1623 nt, Artificial Sequence; identical to SEQ ID NO: 9489
  derived and/or modified sequence opt1 from VP1__Norovirus__AGS08107

SEQ ID NO: 9546 - RNA, 1623 nt, Artificial Sequence
  derived and/or modified sequence opt1 from VP1__Norovirus__AGS08108
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggagcuccuacgacccgaccgaggagauccccgcgccccuggggacgcccgacuucgucggcaagauccagggggugcucacccagaccacccggacggacggcagcacccgcgggcacaaggccaccguguacaccggcuccgccgacuucagcccgaagcugggccggguccaguucgccacggacaccgacaacgacuucgugaccaaccagaacaccaaguucacgcccgugggggucauccaggacggcuccaccacgccccgcaacgagccccagcagugggugcugccgagcuacuccgggcggaacacccacaacgugcaccucgcccccgccgucgcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggguacgugaccgucgcgcacaccggccagcacgaccuggugaucccgcccaacggguacuuccgguucgacagcugggugaaccaguucuacacgcuggcccccaugggcaacgggaccggccgccgccgggcccucuga

SEQ ID NO: 9547 - RNA, 1623 nt, Artificial Sequence
  derived and/or modified sequence opt1 from VP1__Norovirus__AGS08109
augaagauggccagcuccgacgccaaccccagcgacggcuccgcggccaaccuggugccggaggucaacaacgaggugauggcccucgagcccguggccggggccgcgaucgccgcccccgucgccggccagcagaacgugaucgaccccuggauccgcaacaacuucgugcaggcgcccgggggcgaguucaccgucagcccccggaacgcccccggggagauccugugguccgcgccccugggcccggaccucaaccccuaccugagccaccuggcccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgacagcaccaucaagcugaucgcgaugcucuacacgccccugcgggccaacaacgccggcgacgacguguucaccgucuccugccgcgugcugacccggcccagcccggacuucgacuucaucuuccucgugccgcccaccgucgagucccgcaccaagcccuucagcgugcccgugcugacggucgaggagaugaccaacucccgguuccccaucccccuggagaagcuguucaccggccccagcuccgccuucgugguccagccgcagaacgggcgcugcaccacggacggcgugcuccuggggaccacccagcucagccccgugaacaucugcaccuuccggggcgacgucacgcacaucaccggcucccgcaacuacaccaugaaccuggccagccagaacuggaacaacuacgaccccaccgaggagaucccggcgccccuggggacgcccgacuucgugggcaagauccaggggaugcucacccagaccacccggacggacggcagcacccgcgggcacaaggccaccguguacaccggcuccgccgacuucgcccccaagcugggccggguccaguucgagacggacaccgaccacgacuucgaggccaaccagaacaccaaguucaccccggugggggugauccaggacggcagcacgacccaccgcaacgagccccagcaguggguccugcccuccuacagcgggcggaacacccacaacgugcaccucgcgcccgccguggccccgaccuuccccggcgagcagcugcuguucuuccgcuccacgaugcccgggugcagcggcuaccccaacauggaccucgacugccugcugccgcaggaguggguccaguacuucuaccaggaggccgcgcccgcccaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccggguggucuga

SEQ ID NO: 9548 - RNA, 1623 nt, Artificial Sequence
  derived and/or modified sequence opt1 from VP1__Norovirus__AGS08110
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccacaacuacaccaugaaccuggccagccagaacuggaacagcuacgacccgaccgaggagauccccgcgccccuggggacgcccgacuucgucggcaagauccagggggugcucacccagaccaccuccacgaacggcagcacccgcgggcacaaggccaccguguacaccggcuccgccgacuucagcccgaagcugggccggguccaguucgccacggacaccaacaacgacuucgagaccaaccagaacaccaaguucacgcccgugggggugauccaggacggcuccaccacgccccgcaacgagccccagcaguggguccugccgagcuacuccgggcggaacauccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggcggcccccgcccagagcgacguggcccuccugcgguucgugaacccggacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccggcgcgcccucuga

SEQ ID NO: 9549 - RNA, 1623 nt, Artificial Sequence
  derived and/or modified sequence opt1 from VP1__Norovirus__AGS08111
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccaguacgaccuggucaucccgcccaacggguacuuccgguucgacagcugggugaaccaguucuacacccuggcccccaugggcaacgggacgggccgccgccgggcccucuga

SEQ ID NO: 9550 - RNA, 1623 nt, Artificial Sequence; identical to SEQ ID NO: 9034
  derived and/or modified sequence opt1 from VP1__Norovirus__AGS08112

SEQ ID NO: 9551 - RNA, 1623 nt, Artificial Sequence
  derived and/or modified sequence opt1 from VP1__Norovirus__AGS08113
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucgugaccaaccagaacaccaaguucacgcccgugggggucauccaggacggcagcaccacgccccgcaacgagccccagcagugggugcugccguccuacagcgggcggaacacccacaacgugcaccucgcccccgccgucgcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacguggcccuccugcgguucgucaacccggacaccggccgcgugcuguucgagugcaagcuccacaagagcggguacgugaccgucgcgcacaccggccagcacgaccuggugaucccgcccaacggguacuuccgguucgacuccugggugaaccaguucuacacgcuggcccccaugggcaacggggccggccgccgccgggcccucuga

SEQ ID NO: 9552 - RNA, 1623 nt, Artificial Sequence; identical to SEQ ID NO: 9489
  derived and/or modified sequence opt1 from VP1__Norovirus__AGS08114

SEQ ID NO: 9553 - RNA, 1623 nt, Artificial Sequence; identical to SEQ ID NO: 9034
  derived and/or modified sequence opt1 from VP1__Norovirus__AGS08115

SEQ ID NO: 9554 - RNA, 1623 nt, Artificial Sequence; identical to SEQ ID NO: 9480
  derived and/or modified sequence opt1 from VP1__Norovirus__AGS08116

SEQ ID NO: 9555 - RNA, 1623 nt, Artificial Sequence
  derived and/or modified sequence opt1 from VP1__Norovirus__AGS08117
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccaggggaugcucacccagaccacccggacggacggcuccacccgcgggcacaaggccaccguguacaccggcagcgccgacuucuccccgaagcugggccgggugcaguucgccacggacaccgacaacgacuucgucaccaaccagaacaccaaguucacgcccgugggggugauccaggacggcagcaccacgccccgcaacgagccccagcaguggguccugccguccuacagcgggcggaacacccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacgcuggcccccaugggcaacgggaccggccgccgccgggcccucuga

SEQ ID NO: 9556 - RNA, 1623 nt, Artificial Sequence; identical to SEQ ID NO: 9489
  derived and/or modified sequence opt1 from VP1__Norovirus__AGS08119

SEQ ID NO: 9557 - RNA, 1623 nt, Artificial Sequence; identical to SEQ ID NO: 9535
  derived and/or modified sequence opt1 from VP1__Norovirus__AGS08120

SEQ ID NO: 9558 - RNA, 1623 nt, Artificial Sequence; identical to SEQ ID NO: 9489
  derived and/or modified sequence opt1 from VP1__Norovirus__AGS08121

SEQ ID NO: 9559 - RNA, 1623 nt, Artificial Sequence
  derived and/or modified sequence opt1 from VP1__Norovirus__AGS08122
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucgugaccaaccagaacaccaaguucacgcccgugggggucauccaggacggcaacaccacgccccgcaacgagccccagcagugggugcugccgagcuacuccgggcggaacacccacaacgugcaccucgcccccgccgucgcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaagcccggguacgugaccgucgcgcacaccggccagcacgaccuggugaucccgcccaacggguacuuccgguucgacuccugggugaaccaguucuacacgcuggcccccaugggcaacgggaccggccgccgccgggcccucuga

SEQ ID NO: 9560 - RNA, 1623 nt, Artificial Sequence
  derived and/or modified sequence opt1 from VP1__Norovirus__AGS08124
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccggggccuucgucgugcagccccagaacggccgcugcacgaccgacgggguccuccugggcaccacccagcucagccccgugaacaucugcacguuccggggcgacgugacccacaucuccgggagccgcaacuacaccaugaaccuggccucccagaacuggaacagcuacgacccgaccgaggagauccccgcgccccugggcacgcccgacuucgucgggaagauccagggcgugcucacccagaccacccggacggacgggagcacccgcggccacaaggccaccguguacaccggcuccgccgacuucagcccgaagcuggggcggguccaguucgccacggacaccgacuccgacuucgugaccaaccagaacaccaaguucacgcccgugggcgucauccaggacgggagcaccacgccccgcaacgagccccagcagugggugcugccguccuacagcggccgguccacccacaacgugcaccucgcccccgccgucgcccccaccuuccccggggagcagcugcuguucuuccgcagcaccaugccgggcugcuccggcuaccccaacauggaccucgacugccugcugccccaggagugggugcaguacuucuaccaggaggcggcccccgcccagagcgacguggcccuccugcgguucgucaacccggacaccgggcgcgugcuguucgagugcaagcuccacaaguccggcuacgugaccgucgcgcacaccgggcagcacgaccuggugaucccgcccaacggcuacuuccgguucgacagcugggugaaccaguucuacacgcuggcccccauggggaacggcaccggccgccgccgggcccucuga

SEQ ID NO: 9561 - RNA, 1623 nt, Artificial Sequence
  derived and/or modified sequence opt1 from VP1__Norovirus__AGS08125
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccguguucgccccgaagcugggccggguccaguucgagacggacaccgaccacgacuucgaggccaaccagaacaccaaguucacccccgugggggugauccaggacggcagcacgacccaccgcaacgagccccagcaguggguccugcccuccuacagcgggcggaacaccccgaacgugcaccucgcccccgcgguggcccccaccuuccccggcgagcagcugcuguucuuccgcuccacgaugccggggugcagcggcuaccccaacauggaccucgacugccugcugccccaggaguggguccaguacuucuaccaggaggccgcccccgcgcaguccgacguggcccuccugcgguucgugaacccggacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccgggcccucuga

SEQ ID NO: 9562 - RNA, 1623 nt, Artificial Sequence; identical to SEQ ID NO: 9499
  derived and/or modified sequence opt1 from VP1__Norovirus__AGS08126

SEQ ID NO: 9563 - RNA, 1623 nt, Artificial Sequence; identical to SEQ ID NO: 9034
  derived and/or modified sequence opt1 from VP1__Norovirus__AGS08127

SEQ ID NO: 9564 - RNA, 1623 nt, Artificial Sequence
  derived and/or modified sequence opt1 from VP1__Norovirus__AGS08128
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacggacggcagcacccgcgggcacaaggccaccguguacaccggcuccgccgacuucagccccaagcugggccggguccaguucgccacggacaccgacaacgacuucgugaccaaccagaacaccaaguucacgcccgugggggucauccaggacggcuccaccacgccccgcaacgagccgcagcagugggugcugcccagcuacuccgggcggaacacccacaacgugcaccucgcccccgccgucgcccccaccuucccgggcgagcagcugcuguucuuccgcagcaccaugcccgggugcuccggcuaccccaacauggaccucgacugccugcugccccaggagugggugcaguacuucuaccaggaggcggccccggcccagagcgacguggcccuccugcgguucgucaaccccgacaccggccgcgugcuguucgagugcaagcuccacaaguccggguacgugaccgucgcgcacaccggccagcacgaccuggugaucccgcccaacggguacuuccgguucgacagcugggugaaccaguucuacacgcuggcccccaugggcaacgggaccggccgccgccgggcccucuga

SEQ ID NO: 9565 - RNA, 1623 nt, Artificial Sequence
  derived and/or modified sequence opt1 from VP1__Norovirus__AGS08129
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccacaacuacaccaugaaccuggccagccagaacuggaacagcuacgacccgaccgaggagauccccgcgccccuggggacgcccgacuucgucggcaagauccaggggaugcucacccagaccacccgcacggacggcuccacccgggggcacaaggccaccguguacaccggcagcguggacuucuccccgaagcugggccgcguccaguucacgaccgacaccgacaacgacuucgagaccaaccagaacacgaaguucacccccgugggggugauccaggacggcagcaccacccaccggaacgagccccagcaguggguccugcccuccuacagcgggcgcaacacgcacaacgugcaccucgccccggccguggcccccaccuuccccggcgagcagcugcuguucuuccgguccaccaugcccgggugcagcggcuacccgaacauggaccucgacugccugcugccccaggaguggguccaguacuucuaccaggaggccgcccccgcgcaguccgacguggcccuccugcgcuucgugaaccccgacaccggccggguccuguucgagugcaagcuccacaagagcggguacgugaccguggcccacacgggccagcacgaccuggucaucccgcccaacggguacuuccgcuucgacuccugggugaaccaguucuacacccuggcccccaugggcaacgggaccggccggcgccgcgcgcucuga

SEQ ID NO: 9566 - RNA, 1623 nt, Artificial Sequence
  derived and/or modified sequence opt1 from VP1__Norovirus__AGS08130
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccgggccgacggcuccacgcgcgggcacaaggccaccguguacaccggcagcgccgacuucuccccgaagcugggccggguccaguucgccaccgacacggacaacgacuucguggccaaccagaacaccaaguucacccccgugggggucauccaggacggcagcaccacgccccgcaacgagccccagcagugggugcugccguccuacagcgggcggaacacccacaacgugcaccucgcccccgcggucgcccccaccuuccccggcgagcagcugcuguucuuccgcuccaccaugccggggugcagcggcuaccccaacauggaccucgacugccugcugccccaggagugggugcaguacuucuaccaggaggccgcccccgcgcaguccgacguggcccuccugcgguucgucaacccggacacgggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggaccggccgccgccgggcccucuga

SEQ ID NO: 9567 - RNA, 1623 nt, Artificial Sequence
  derived and/or modified sequence opt1 from VP1__Norovirus__AGS08131
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcaacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaucggcagcgccgacuucgccccgaagcugggccgggugcaguucgagaccgacacggaccacgacuucgaggccaaccagaacaccaaguucacccccgucggggugauccaggacggcgggaccacgcaccgcaacgagccccagcagugggugcugcccuccuacagcggccggaacacccacaacguccaccucgccccggcgguggcccccaccuuccccggggagcagcugcuguucuuccgcuccaccaugcccggcugcagcggcuacccgaacauggaccucgacugccugcugccccaggagugggugcaguacuucuaccaggaggccgcccccgcgcaguccgacgucgcccuccugcgguucgugaaccccgacacggggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcaccggccgccgccgggccguguga

SEQ ID NO: 9568 - RNA, 1623 nt, Artificial Sequence
  derived and/or modified sequence opt1 from VP1__Norovirus__AGS08132
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccacaacuacaccaugaaccuggccagccagaacuggaacagcuacgacccgaccgaggagauccccgcgccccuggggacgcccgacuucgucggcaagauccagggggugcucacccagaccacccgcacggacggcuccacccgggggcacaaggccaccguguacaccggcagcgccgacuucuccccgaagcugggccgcguccaguucgccacggacaccgacaacgacuucgagaccaaccagaacaccaaguucacgcccgugggggugauccaggacggcgggaccacccaccggaacgagccccagcaguggguccugcccagcuacuccggccgcaacauccacaacgugcaccucgccccggccguggcccccaccuuccccggggagcagcugcuguucuuccggagcacgaugcccggcugcuccggcuacccgaacauggaccucgacugccugcugccccaggaguggguccaguacuucuaccaggaggcggcccccgcccagagcgacguggcccuccugcgcuucgugaaccccgacaccgggcggguccuguucgagugcaagcuccacaaguccggcuacgugaccguggcgcacaccgggcagcacgaccuggucaucccgcccaacggcuacuuccgcuucgacagcugggugaaccaguucuacacccuggcccccauggggaacggcacgggccggcgccgcgcccucuga

SEQ ID NO: 9569 - RNA, 1623 nt, Artificial Sequence
  derived and/or modified sequence opt1 from VP1__Norovirus__AGS08133
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccuccuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgacccgaccgaggagauccccgcgccccuggggacgcccgacuucgucggcaagauccagggggugcucacccagaccacccggacggacggcagcacccgcgggcacaaggccaccguguacaccggcuccgccgacuucagcccgaagcugggccggguccaguucgccacggacaccgacaacgacuucgugaccaaccagaacaccaaguucacgcccgugggggucauccaggacggcuccaccacgccccgcaacgagccccagcagugggugcugccgagcuacuccgggcggaacacccacaacgugcaccucgcccccgccgucgcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggguacgugaccgucgcgcacaccggccagcacgaccuggugaucccgcccaacggguacuuccgguucgacagcugggugaaccaguucuacacgcuggcccccaugggcaacgggaccggccgccgccgggcccucuga

SEQ ID NO: 9570 - RNA, 1623 nt, Artificial Sequence
  derived and/or modified sequence opt1 from VP1__Norovirus__AGS08134
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacgugugcacguuccggggcgacgugacccacauccccggcucccacaacuacaccaugaaccuggccagccagaacuggaacagcuacgacccgaccgaggagauccccgcgccccuggggacgcccgacuucgucggcaagauccagggggugcucacccagaccaccuccacgaacggcagcacccgcgggcacaaggccaccguguacaccggcuccgccgacuucagcccgaagcugggccggguccaguucgccacggacaccaacaacgacuucgagaccaaccagaacaccaaguucacgcccgugggggugauccaggacggcuccaccacgccccgcaacgagccccagcaguggguccugccgagcuacuccgggcggaacauccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggcggcccccgcccagagcgacguggcccuccugcgguucgugaacccggacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccggcgcgcccucuga

SEQ ID NO: 9571 - RNA, 1623 nt, Artificial Sequence
  derived and/or modified sequence opt1 from VP1__Norovirus__AGS08135
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucgugcucgccgggaacgccuucacggcgggcaagaucaucuucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccgugcugaccgucgaggagaugaccaacagccgguuccccaucccccuggagaagcuguucaccggcccguccagcgccuucgugguccagccccagaacgggcgcugcacgaccgacggcgugcuccuggggaccacccagcucucccccgugaacaucugcacguuccggggcgacgucacccacaucagcggcucccgcaacuacaccaugaaccuggccagccagaacuggaacagcuacgacccgaccgaggagauccccgcgccccuggggacgcccgacuucgugggcaagauccagggggugcucacccagaccacccggacggacggcuccacccgcgggcacaaggccaccgucuacaccggcagcgccgacuucuccccgaagcugggccgggugcaguucgccacggacaccgacaacgacuucgugaccaaccagaacaccaaguucacgcccgucggggugauccaggacggcagcaccacgccccgcaacgagccccagcagugggugcugccguccuacagcgggcggaacacccacaacguccaccucgcccccgccguggcccccaccuuccccggcgagcagcugcuguucuuccgcuccaccaugccggggugcagcggcuaccccaacauggaccucgacugccugcugccccaggagugggugcaguacuucuaccaggaggcggcccccgcccaguccgacgucgcccuccugcgguucgugaacccggacaccggccgcgugcuguucgagugcaagcuccacaagagcggguacgucaccguggcgcacaccggccagcacgaccuggugaucccgcccaacggguacuuccgguucgacuccugggucaaccaguucuacacgcuggcccccaugggcaacgggaccggccgccgccgggcccucuga

SEQ ID NO: 9572 - RNA, 1623 nt, Artificial Sequence; identical to SEQ ID NO: 9489
  derived and/or modified sequence opt1 from VP1__Norovirus__AGS08136

SEQ ID NO: 9573 - RNA, 1623 nt, Artificial Sequence
  derived and/or modified sequence opt1 from VP1__Norovirus__AGS08137
augaagauggccagcuccgacgccaaccccagcgacggcuccagcgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccgugcugacgguggaggagaugaccaacucccgguuccccaucccccuggagaagcuguucaccggcccgagcuccgccuucgucgugcagccccagaacgggcgcugcaccacggacggcguccuccuggggaccacccagcucagccccgugaacaucugcaccuuccggggcgacgugacgcacaucuccggcagccgcaacuacaccaugaaccuggccagccagaacuggaacuccuacgacccgaccgaggagauccccgcgccccuggggacccccgacuucgucggcaagauccagggggugcucacgcagaccacccggaccgacggcagcacgcgcgggcacaaggccaccguguacaccggcuccgccgacuucagcccgaagcugggccggguccaguucgccaccgacacggacaacgacuucgugaccaaccagaacaccaaguucacccccgugggggucauccaggacggcuccacgacgccccgcaacgagccccagcagugggugcugccgagcuacuccgggcggaacacccacaacgugcaccucgcccccgccgucgcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacguggcccuccugcgguucgucaacccggacaccggccgcgugcuguucgagugcaagcuccacaaguccggguacgugaccgucgcgcacaccggccagcacgaccuggugaucccgcccaacggguacuuccgguucgacagcugggugaaccaguucuacacccuggcccccaugggcaacgggacgggccgcaagcgcgcccucuga

SEQ ID NO: 9574 - RNA, 1623 nt, Artificial Sequence; identical to SEQ ID NO: 9510
  derived and/or modified sequence opt1 from VP1__Norovirus__AGS08138

SEQ ID NO: 9575 - RNA, 1623 nt, Artificial Sequence
  derived and/or modified sequence opt1 from VP1__Norovirus__AGS08139
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccaucccccuggagaagcuguucaccggccccagcuccgccuucgucgugcagccgcagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgaccccaccgaggagaucccggcgccccuggggacgcccgacuucgugggcaagauccaggggaugcucacccagaccacccggacggacggcagcacccgcgggcacaaggccaccgucuacaccggcuccgccgacuucgcccccaagcugggccgggugcaguucgagacggacaccgaccacgacuucgaggccaaccagaacaccaaguucaccccggugggggucauccaggacggcagcacgacccaccgcaacgagccccagcagugggugcugcccuccuacagcgggcggaacacccacaacgugcaccucgcccccgcggucgccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacguggcccuccugcgguucgucaaccccgacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgggucguguga

SEQ ID NO: 9576 - RNA, 1623 nt, Artificial Sequence
  derived and/or modified sequence opt1 from VP1__Norovirus__AGS08140
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcgggacgacccaccgcaacgagccccagcagugggugcugcccagcuacuccggccggaacacccacaacguccaccucgcccccgcgguggccccgaccuuccccggggagcagcugcuguucuuccgcagcacgaugcccggcugcuccggcuaccccaacauggaccucgacugccugcugccgcaggagugggugcaguacuucuaccaggaggccgcccccgcgcagagcgacgucgcccuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgggugguguga

SEQ ID NO: 9577 - RNA, 1623 nt, Artificial Sequence
  derived and/or modified sequence opt1 from VP1__Norovirus__AGS08141
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccugggggcccccgacuucgugggcaagauccaggggaugcucacgcagaccacccggaccgacggcagcacgcgcgggcacaaggccaccgucuacaccggcagcgccgacuucgccccgaagcugggccgggugcaguucgagaccgacacggaccacgacuucgaggccaaccagaacaccaaguucacccccgugggggucauccaggacggcuccaccacgcaccgcaacgagccccagcagugggugcugcccagcuacuccgggcggaacacccacaacgugcaccucgcgccggccgucgcccccaccuuccccggcgagcagcugcuguucuuccgcagcaccaugcccgggugcuccggcuacccgaacauggaccucgacugccugcugccccaggagugggugcaguacuucuaccaggaggccgcgcccgcccagagcgacguggcccuccugcgguucgucaaccccgacacgggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggaccggccgccgccgggucguguga

SEQ ID NO: 9578 - RNA, 1623 nt, Artificial Sequence
  derived and/or modified sequence opt1 from VP1__Norovirus__AGS08142
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcgccaagcccuucuccgugcccguccugaccguggaggagaugacgaacagccgguuccccaucccccuggagaagcuguucaccggcccguccagcgccuucgucgugcagccccagaacgggcgcugcaccaccgacggcgugcuccuggggacgacccagcucucccccgucaacaucugcaccuuccggggcgacgugacccacaucacgggcagccgcaacuacaccaugaaccuggccucccagaacuggagcaacuacgacccgaccgaggagauccccgcgccccuggggacccccgacuucgugggcaagauccaggggguccucacgcagaccacccggaccgacggcagcacgcgcgggcacaaggccaccguguacaccggcuccgccgacuucgccccgaagcugggccgggugcaguucgagaccgacacggaccacgacuucgaggccaaccagaacaccaaguucacccccgucggggugauccaggacggcagcaccacgcaccgcaacgagccccagcagugggugcugcccuccuacagcgggcggaacaccccgaacguccaccucgcgcccgccguggcccccaccuuccccggcgagcagcugcuguucuuccgcuccaccaugccggggugcagcggcuaccccaacauggaccucgacugccugcugccccaggagugggugcaguacuucuaccaggaggccgcgcccgcccaguccgacgucgcccuccugcgguucgugaacccggacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgggcgcccuga

SEQ ID NO: 9579 - RNA, 1623 nt, Artificial Sequence; identical to SEQ ID NO: 8842
  derived and/or modified sequence opt1 from VP1__Norovirus__AGS08143

SEQ ID NO: 9580 - RNA, 1623 nt, Artificial Sequence
  derived and/or modified sequence opt1 from VP1__Norovirus__AGS08144
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaagcccggguacgugaccguggcgcacaccggccagcacgaccuggucaucccgcccaacggguacuuccgguucgacuccugggugaaccaguucuacacccuggcccccaugggcaacgggacgggccgccgccgggcccucuga

SEQ ID NO: 9581 - RNA, 1623 nt, Artificial Sequence
  derived and/or modified sequence opt1 from VP1__Norovirus__AGS08145
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacauccccggcucccacaacuacaccaugaaccuggccagccagaacuggaacagcuacgacccgaccgaggagacgcccgcgccccuggggacccccgacuucgugggcaagauccaggggguccucacccagaccacguccaccaacggcagcacccgcgggcacaaggccaccguguacacgggcuccgccgacuucagcccgaagcugggccgggugcaguucgccaccgacaccaacaacgacuucgagaccaaccagaacacgaaguucacccccgucggggugauccaggacggcuccaccacgccccgcaacgagccccagcagugggugcugccgagcuacuccgggcggaacauccacaacguccaccucgcccccgccguggcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacgucgcccuccugcgguucgugaacccggacaccggccgcgugcuguucgagugcaagcuccacaaguccggguacgucaccguggcgcacaccggccagcacgaccuggugaucccgcccaacggguacuuccgguucgacagcugggucaaccaguucuacacgcuggcccccaugggcaacgggaccggccgccggcgcgcccucuga

SEQ ID NO: 9582 - RNA, 1623 nt, Artificial Sequence; identical to SEQ ID NO: 9541
  derived and/or modified sequence opt1 from VP1__Norovirus__AGS08146

SEQ ID NO: 9583 - RNA, 1623 nt, Artificial Sequence; identical to SEQ ID NO: 8882
  derived and/or modified sequence opt1 from VP1__Norovirus__AGS08147

SEQ ID NO: 9584 - RNA, 1623 nt, Artificial Sequence; identical to SEQ ID NO: 9489
  derived and/or modified sequence opt1 from VP1__Norovirus__AGS08148

SEQ ID NO: 9585 - RNA, 1623 nt, Artificial Sequence
  derived and/or modified sequence opt1 from VP1__Norovirus__AGS08149
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccuguggaacgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggaagugcacgaccgacggcguccuccuggggaccacccagcucagccccgugaacaucugcacguuccgcggcgacgugacccacaucccgggcucccggaacuacaccaugaaccuggccagccagaacuggaacuccuacgaccccaccgaggagauccccgcgccccuggggacgccggacuucgucggcaagauccagggggugcucacccagaccacccgcacgaacggcagcacccgggggcacaaggccaccguguacaccggcagcgccgacuucucccccaagcugggccgcguccaguucgccacggacaccgacaacgacuucgagaccaaccagaacaccaaguucacgcccgugggggugauccaggacggcagcaccacgccccggaacgagccgcagcaguggguccugcccuccuacagcgggcgcaacauccacaacgugcaccucgcccccgccguggcccccaccuucccgggcgagcagcugcuguucuuccgguccaccaugcccgggugcagcggcuaccccaacauggaccucgacugccugcugccccaggaguggguccaguacuucuaccaggaggcggccccggcccaguccgacguggcccuccugcgcuucgugaaccccgacaccggccggguccuguucgagugcaagcuccacaagagcggguacgugaccguggcgcacaccggccagcacgaccuggucaucccgcccaacggguacuuccgcuucgacuccugggugaaccaguucuacacccuggcccccaugggcaacgggacgggccggcgccgcgcccucuga

SEQ ID NO: 9586 - RNA, 1623 nt, Artificial Sequence; identical to SEQ ID NO: 9535
  derived and/or modified sequence opt1 from VP1__Norovirus__AGS08150

SEQ ID NO: 9587 - RNA, 1623 nt, Artificial Sequence
  derived and/or modified sequence opt1 from VP1__Norovirus__AGS08152
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccgugcugacgguggaggagaugaccaacagccgguuccccgucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccacaacuacaccaugaaccuggccucccagaacuggaacagcuacgacccgaccgaggagauccccgcgccccuggggacgcccgacuucgugggcaagauccagggggugcucacccagaccacccgcgccaacggcagcacgcgggggcacaaggccaccgucuacaccggcuccgccgacuucgccccgaagcugggccgcgugcaguucgccaccgacacgaacaacgacuucgacgcgaaccagaacaccaaguucacccccgugggggucauccaggacggcgacaccgcccaccggaacgagccccagcagugggugcugcccagcuacuccgggcgcaacagccacaacgugcaccucgccccggccgucgcgcccacguuccccggcgagcagcugcuguucuuccgguccaccaugcccgggugcagcggcuacccgaacauggaccucgacugccugcugccccaggagugggugcaguacuucuaccaggaggccgcccccgcccaguccgacguggcccuccugcgcuucgucaaccccgacaccggccgggugcuguucgagugcaagcuccacaagagcggguacgugaccgucgcgcacacgggccagcacgaccuggugaucccgcccaacggguacuuccgcuucgacuccugggugaaccaguucuacacccuggcccccaugggcaacgggaccggccggcgccgcgcccucuga

SEQ ID NO: 9588 - RNA, 1623 nt, Artificial Sequence
  derived and/or modified sequence opt1 from VP1__Norovirus__AGS08153
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccgugcugacgguggaggagaugaccaacagccgguuccccgucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccacaacuacaccaugaaccuggccucccagaacuggaacagcuacgacccgaccgaggagauccccgcgccccuggggacgcccgacuucgugggcaagauccagggggugcucacccagaccacccgcgccgacggcagcacgcgggggcacaaggccaccgucuacaccggcuccgccgacuucgccccgaagcugggccgcgugcaguucgccaccgacacgaacaacgacuucgacgcgaaccagaacaccaaguucacccccgugggggucauccaggacggcgacaccgcccaccggaacgagccccagcagugggugcugcccagcuacuccgggcgcaacagccacaacgugcaccucgccccggccgucgcgcccacguuccccggcgagcagcugcuguucuuccgguccaccaugcccgggugcagcggcuacccgaacauggaccucgacugccugcugccccaggagugggugcaguacuucuaccaggaggccgcccccgcccaguccgacguggcccuccugcgcuucgucaaccccgacaccggccgggugcuguucgagugcaagcuccacaagagcggguacgugaccgucgcgcacacgggccagcacgaccuggugaucccgcccaacggguacuuccgcuucgacuccugggugaaccaguucuacacccuggcccccaugggcaacgggaccggccggcgccgcgcccucuga

SEQ ID NO: 9589 - RNA, 1623 nt, Artificial Sequence
  derived and/or modified sequence opt1 from VP1__Norovirus__AGS08154
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgagguggaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggacccucacccagaccacgcggaccgacggcagcacccgcgggcacaaggccaccguguacacgggcuccgccgacuucgcccccaagcugggccgggugcaguucgagaccgacaccgaccacgacuucgaggccaaccagaacaccaaguucacgccggucggggugauccaggacggcagcaccacccaccgcaacgagccccagcagugggugcugcccuccuacagcgggcggaacacccacaacguccaccucgcccccgcgguggccccgacguuccccggcgagcagcugcuguucuuccgcuccaccaugcccgggugcagcggcuaccccaacauggaccucgacugccugcugccgcaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacgcuggcccccaugggcaacgggaccggccgccgccgggugguguga

SEQ ID NO: 9590 - RNA, 1623 nt, Artificial Sequence; identical to SEQ ID NO: 9497
  derived and/or modified sequence opt1 from VP1__Norovirus__AGS08157

SEQ ID NO: 9591 - RNA, 1623 nt, Artificial Sequence
  derived and/or modified sequence opt1 from VP1__Norovirus__AGS08158
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgggugaucuga

SEQ ID NO: 9592 - RNA, 1623 nt, Artificial Sequence; identical to SEQ ID NO: 9501
  derived and/or modified sequence opt1 from VP1__Norovirus__AGS08160

SEQ ID NO: 9593 - RNA, 1623 nt, Artificial Sequence
  derived and/or modified sequence opt1 from VP1__Norovirus__AGS08161
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcagcacgacccaccgcaacgagccccagcagugggugcugcccuccuacagcgggcggaacacccacaacguccaccucgcccccgcgguggccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgggccguguga

SEQ ID NO: 9594 - RNA, 1623 nt, Artificial Sequence
  derived and/or modified sequence opt1 from VP1__Norovirus__AGS08162
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcagcacgacccaccgcaacgagccccagcagugggugcugcccuccuacagcgggcggaacacccacaacguccaccucgcccccgcgguggccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgggugguguga

SEQ ID NO: 9595 - RNA, 1623 nt, Artificial Sequence; identical to SEQ ID NO: 9594
  derived and/or modified sequence opt1 from VP1__Norovirus__AGS08163

SEQ ID NO: 9596 - RNA, 1623 nt, Artificial Sequence; identical to SEQ ID NO: 9499
  derived and/or modified sequence opt1 from VP1__Norovirus__AGS08164

SEQ ID NO: 9597 - RNA, 1623 nt, Artificial Sequence
  derived and/or modified sequence opt1 from VP1__Norovirus__AGS08165
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgagguggaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcagcacgacccaccgcaacgagccccagcagugggugcugcccuccuacagcgggcggaacacccacaacguccaccucgcccccgcgguggccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgggugguguga

SEQ ID NO: 9598 - RNA, 1623 nt, Artificial Sequence; identical to SEQ ID NO: 9594
  derived and/or modified sequence opt1 from VP1__Norovirus__AGS08166

SEQ ID NO: 9599 - RNA, 1623 nt, Artificial Sequence
  derived and/or modified sequence opt1 from VP1__Norovirus__AGS08167
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcaacgccuucgucgugcagccgcagaacgggcgcugcaccacggacggcguccuccuggggaccacccagcucucccccgugaacaucugcaccuuccggggcgacgugacgcacaucaccggcagccgcaacuacaccaugaaccuggccucccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcagcgccgacuucgcccccaagcugggccgggugcaguucgagacggacaccgaccacgacuucgaggccaaccagaacaccaaguucaccccggucggggugauccaggacggcuccacgacccaccgcaacgagccccagcagugggugcugcccagcuacuccgggcggaacacccacaacguccaccucgcccccgcgguggccccgaccuuccccggcgagcagcugcuguucuuccgcagcacgaugcccgggugcuccggcuaccccaacauggaccucgacugccugcugccgcaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgggugguguga

SEQ ID NO: 9600 - RNA, 1623 nt, Artificial Sequence; identical to SEQ ID NO: 9597
  derived and/or modified sequence opt1 from VP1__Norovirus__AGS08168

SEQ ID NO: 9601 - RNA, 1623 nt, Artificial Sequence
  derived and/or modified sequence opt1 from VP1__Norovirus__AGS08169
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacauccgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccaucccccuggagaagcuguucaccggccccagcuccgccuucgugguccagccgcagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgaccccaccgaggagaucccggcgccccuggggacgcccgacuucgugggcaagauccaggggguccucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcagcacgacccaccgcaacgagccccagcagugggugcugcccuccuacagcgggcggaacacccacaacguccaccucgcccccgcgguggccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgggugguguga

SEQ ID NO: 9602 - RNA, 1623 nt, Artificial Sequence; identical to SEQ ID NO: 9594
  derived and/or modified sequence opt1 from VP1__Norovirus__AGS08170

SEQ ID NO: 9603 - RNA, 1623 nt, Artificial Sequence
  derived and/or modified sequence opt1 from VP1__Norovirus__AGS08171
augaagauggccagcuccgacgccaaccccagcgacggcuccgcggccaaccuggugccggaggucaacaacgaggugauggcccucgaccccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcagcacgacccaccgcaacgagccccagcagugggugcugcccuccuacagcgggcggaacacccacaacguccaccucgcccccgcgguggccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgggugguguga

SEQ ID NO: 9604 - RNA, 1623 nt, Artificial Sequence; identical to SEQ ID NO: 9499
  derived and/or modified sequence opt1 from VP1__Norovirus__AGS08172

SEQ ID NO: 9605 - RNA, 1623 nt, Artificial Sequence; identical to SEQ ID NO: 9597
  derived and/or modified sequence opt1 from VP1__Norovirus__AGS08173

SEQ ID NO: 9606 - RNA, 1623 nt, Artificial Sequence; identical to SEQ ID NO: 9594
  derived and/or modified sequence opt1 from VP1__Norovirus__AGS08174

SEQ ID NO: 9607 - RNA, 1623 nt, Artificial Sequence; identical to SEQ ID NO: 9493
  derived and/or modified sequence opt1 from VP1__Norovirus__AGS08175

SEQ ID NO: 9608 - RNA, 1623 nt, Artificial Sequence; identical to SEQ ID NO: 9594
  derived and/or modified sequence opt1 from VP1__Norovirus__AGS08176

SEQ ID NO: 9609 - RNA, 1623 nt, Artificial Sequence; identical to SEQ ID NO: 9597
  derived and/or modified sequence opt1 from VP1__Norovirus__AGS08177

SEQ ID NO: 9610 - RNA, 1623 nt, Artificial Sequence; identical to SEQ ID NO: 9594
  derived and/or modified sequence opt1 from VP1__Norovirus__AGS08178

SEQ ID NO: 9611 - RNA, 1623 nt, Artificial Sequence; identical to SEQ ID NO: 9594
  derived and/or modified sequence opt1 from VP1__Norovirus__AGS08179

SEQ ID NO: 9612 - RNA, 1623 nt, Artificial Sequence; identical to SEQ ID NO: 9594
  derived and/or modified sequence opt1 from VP1__Norovirus__AGS08180

SEQ ID NO: 9613 - RNA, 1623 nt, Artificial Sequence; identical to SEQ ID NO: 9597
  derived and/or modified sequence opt1 from VP1__Norovirus__AGS08181

SEQ ID NO: 9614 - RNA, 1623 nt, Artificial Sequence; identical to SEQ ID NO: 9597
  derived and/or modified sequence opt1 from VP1__Norovirus__AGS08182

SEQ ID NO: 9615 - RNA, 1647 nt, Artificial Sequence
  derived and/or modified sequence opt1 from VP1__Norovirus__AGT39181
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcuggucgccaugcuguacaccccgcuccgcgccaacaacuccggcgacgacguguucacggugagcugccggguccugacccgccccucccccgacuucagcuucaacuuccuggugcccccgaccguggaguccaagaccaagcccuucacgcuccccauccugaccaucagcgagauguccaacagccgguuccccgucccgaucgacucccugcacaccagccccaccgagaacaucguggugcagugccagaacgggcgcgucacgcucgacggcgagcugauggggaccacccagcugcuccccucccagaucugcgccuuccggggcgugcugacccgcagcacgucccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaagguguucggcgucgccagccagcgcaaccccgacuccaccacccgggcccacgaggcgaagguggacaccacggccgggcgcuucacccccaagcucggcagccuggagaucuccaccgagagcggcgacuucgaccagaaccagccgacccgguucacgcccgucgggaucggcguggaccgcgaggccgacuuccagcaguggucccugcccgacuacagcgggcaguucacccacaacaugaaccucgcccccgcgguggccccgaacuuccccggcgagcagcugcuguucuuccggucccagcuccccagcuccgggggccgcagcaacggcauccuggacugccuggucccccaggagugggugcagcacuucuaccaggaguccgccccggcccagacccagguggcccucguccgcuacgugaaccccgacaccgggcgggugcuguucgaggcgaagcugcacaagcucggcuucaugacgaucgccaagaacggggacagccccaucaccgugcccccgaacggcuacuuccgcuucgaguccugggugaaccccuucuacacccuggcccccauggggaccggcaacggccggcgccggauccaguga

SEQ ID NO: 9616 - RNA, 1608 nt, Artificial Sequence
  derived and/or modified sequence opt1 from VP1__Norovirus__AGT39191
augaagauggccagcaacgacgccgcgcccuccaacgacggcgccgccgggcuggugccggaggucaccaacgagaccauggcccucgagcccguggcccgcgcgagcaucgccgcgccccugacgggccagaacaacgugaucgaccccuggaucacccugaacuucgggcaggccccgaccggccaccucacccuguccccgcccuacagccccggggagguccugcucaaccuggagcugcggcccgagcucaaccccuaccuggccaaccugucccgcauguacaacggcuacgccggcgggguggaggugcagguccuccuggccggcaacgccuucacggccgggaagcugguguucgcggccgugccgccccacuucccccucgagaacaucagccccggccagaucaccauguucccccacgucaucaucgacgugcggacccuggagcccgugcugcucccgcugcccgacguccgcaacaacuucuuccacuacaaccagcagaacgagccccggaugcgccugguggccaugcucuacacgccccugcgguccaacgggagcggcgacgacguguucaccgucuccugccgcgugcugacccggccgagccccgacuucgacuucaacuaccucgugccgcccaccgucgaguccaagaccaagcccuucacgcugcccauccugaccaucggcgagcucaccaacagccgcuuccccgugcccaucgacgagcuguacaccuccccgaacgagagccuggugguccagccccagaacgggcggugcgcccucgacggcgagcugcaggggacgacccagcugcuccccaccgccaucugcuccuuccgcggccggaucaaccagaaggugagcggcgagaaccacguguggaacaugcagaucaccaacaucaacgggacgccguucgaccccaccgaggacguccccgcgccccugggcaccccggacuucuccgggaagcuguucggcgugcucagccagcgcgaccacgacaacgccugccggucccacgacgccgucaucgccaccaacagcgccaaguucacgcccaagcugggggcgauccagaucggcaccugggagcaggacgacgugcacaucaaccagcccaccaaguucacccccgugggccuguucgagagcgagggguucaaccaguggacgcucccgaacuacuccggcgcccugacccugaacauggggcucgccccgcccgucgcccccaccuuccccggcgagcagauccuguucuuccgcagccacaucccccugaagggcgggguggccgaccccgugaucgacugccuccugccccaggaguggauccagcaccuguaccaggaguccgcgccgagccagaccgacgucgcccucauccgguucacgaaccccgacaccggccgcgugcuguucgaggccaagcugcaccgguccggguacaucaccguggccaacaccggcagccgccccaucgucgugcccgcgaacggguacuuccgguucgacuccugggugaaccaguucuacagccuggccccgaugggcacggggaacggccgccgccggguccaguga

SEQ ID NO: 9617 - RNA, 1608 nt, Artificial Sequence
  derived and/or modified sequence opt1 from VP1__Norovirus__AGT39194
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggaggugcuccugaaccuggagcucggccccgagcugaacccguaccuggcccaccucucccgcauguacaacggcuacgccgggggcgucgagguccaggugcugcuggccgggaacgccuucaccgccggcaagcucguguucgcggccgugccgccccacuucccccuggagaacaucagccccgggcagaucaccauguucccccacgugaucaucgacguccggacccuggagcccgugcuccugccccugccggacgugcgcaacaacuucuuccacuacaaccagcagaacgagccccggaugcgccucgucgccaugcuguacacgccccugcgguccaacggcagcggcgacgacguguucaccguguccugccgcguccucacccggcccagcccggacuucgacuucaacuaccuggugccgcccaccguggaguccaagacgaagcccuucacccugcccauccucaccaucggggagcugaccaacagccgcuuccccguccccaucgacgagcuguacacgucccccaacgagagccucguggugcagccgcagaacggccggugcgcccuggacggggagcugcagggcaccacccagcuccugcccaccgccaucugcuccuuccgcggccggaucaaccagaaggucagcggggagaaccacguguggaacaugcagaucacgaacaucaacggcacccccuucgacccgaccgaggacguccccgcgccccuggggacccccgacuucuccggcaagcuguucggggugcucagccagcgcgaccacgacaacgccugccggucccacgacgccgugaucgccacgaacagcgccaaguucaccccgaagcugggcgcgauccagaucggcaccugggagcaggacgacguccacaucaaccagcccaccaaguucacgcccgugggccucuucgagagcgagggguucaaccaguggacccugcccaacuacuccggggcccugacccucaacaugggccuggccccgcccguggcccccaccuuccccggggagcagauccuguucuuccgcagccacaucccgcucaagggcggcgucgccgaccccgugaucgacugccugcugccccaggaguggauccagcaccucuaccaggaguccgcgcccagccagacggacguggcccugauccgguucaccaacccggacaccgggcgcguccuguucgaggccaagcuccaccgguccggcuacaucaccguggccaacacggggagccgccccaucgugguccccgcgaacggcuacuuccgguucgacuccugggugaaccaguucuacagccuggcccccauggggaccggcaacggccgccgccgggugcaguga

SEQ ID NO: 9618 - RNA, 1608 nt, Artificial Sequence
  derived and/or modified sequence opt1 from VP1__Norovirus__AGT39197
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggaggugcuccugaaccuggagcucggccccgagcugaacccguaccuggcccaccucucccgcauguacaacggcuacgccgggggcgucgagguccaggugcugcuggccgggaacgccuucaccgccggcaagcucguguucgcggccgugccgccccacuucccccuggagaacaucagccccgggcagaucaccauguucccccacgugaucaucgacguccggacccuggagcccgugcuccugccccugccggacgugcgcaacaacuucuuccacuacaaccagcagaacgagccccggaugcgccucgucgccaugcuguacacgccccugcgguccaacggcagcggcgacgacguguucaccguguccugccgcguccucacccggcccagcccggacuucgacuucaacuaccuggugccgcccaccguggaguccaagacgaagcccuucacccugcccauccucaccaucggggagcugaccaacagccgcuuccccguccccaucgacgagcuguacacgucccccaacgagagccucguggugcagccgcagaacggccggugcgcccuggacggggagcugcagggcaccacccagcuccugcccaccgccaucugcuccuuccgcggccggaucaaccagaaggucagcggggagaaccacguguggaacaugcaggucacgaacaucaacggcacccccuucgacccgaccgaggacgugcccgcgccccuggggacccccgacuucuccggcaagcuguucggggugcucagccagcgcgaccacgacaacgccugccggucccacgacgccgucaucgccacgaacagcgccaaguucaccccgaagcugggcgcgauccagaucggcaccugggaggagaacgacgugcacaucaaccagcccaccaaguucacgcccgugggccucuucgagagcgagggguucaaccaguggacccugcccaacuacuccggggcccugacccucaacaugggccuggccccgcccgucgcccccaccuuccccggggagcagauccuguucuuccgcagccacaucccgcucaagggcggcguggccgaccccgugaucgacugccugcugccccaggaguggauccagcaccucuaccaggaguccgcgcccagccagacggacgucgcccugauccgguucaccaacccggacaccgggcgcgugcuguucgaggccaagcuccaccgguccggcuacaucaccguggccaacacggggagccgccccaucgucgugcccgcgaacggcuacuuccgguucgacuccugggugaaccaguucuacagccuggcccccauggggaccggcaacggccgccgccggguccaguga

SEQ ID NO: 9619 - RNA, 1608 nt, Artificial Sequence
  derived and/or modified sequence opt1 from VP1__Norovirus__AGT39200
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggaggugcuccugaaccuggagcucggccccgagcugaacccguaccuggcccaccucucccgcauguacaacggcuacgccgggggcgucgagguccaggugcugcuggccgggaacgccuucaccgccggcaagcucguguucgcggccgugccgccccacuucccccuggagaacaucagccccgggcagaucaccauguucccccacgugaucaucgacguccggacccuggagcccgugcuccugccccugccggacgugcgcaacaacuucuuccacuacaaccagcagaacgagccccggaugcgccucgucgccaugcuguacacgccccugcgguccaacggcagcggcgacgacguguucaccguguccugccgcguccucacccggcccagcccggacuucgacuucaacuaccuggugccgcccaccguggaguccaagacgaagcccuucacccugcccauccucaccaucggggagcugaccaacagccgcuuccccguccccaucgacgagcuguacacgucccccaacgagagccucguggugcagccgcagaacggccggugcgcccuggacggggagcugcagggcaccacccagcuccugcccaccgccaucugcuccuuccgcggccggaucaaccagaaggucagcggggagaaccacguguggaacaugcagaucacgaacaucaacggcacccccuucgggccgaccgaggacguccccgcgccccugggcacccccgacuucuccgggaagcuguucggcgugcucagccagcgcgaccacgacaacgccugccggucccacgacgccgugaucgccacgaacagcgccaaguucaccccgaagcugggcgcgauccagaucgggaccugggagcaggacgacguccacaucaaccagcccaccaaguucacgcccgugggccucuucgagagcgagggguucaaccaguggacccugcccaacuacuccggcgcccugacccucaacauggggcuggccccgcccguggcccccaccuuccccggcgagcagauccuguucuaccgcagccacaucccgcucaagggcggggucgccgaccccgugaucgacugccugcugccccaggaguggauccagcaccucuaccaggaguccgcgcccagccagacggacguggcccugauccgguucaccaacccggacaccggccgcguccuguucgaggccaagcuccaccgguccggguacaucaccguggccaacacgggcagccgccccaucgugguccccgcgaacggguacuuccgguucgacuccugggugaaccaguucuacagccuggcccccaugggcaccggcaacgggcgccgccgggugcaguga

SEQ ID NO: 9620 - RNA, 1608 nt, Artificial Sequence; identical to SEQ ID NO: 9048
  derived and/or modified sequence opt1 from VP1__Norovirus__AGT39203

SEQ ID NO: 9621 - RNA, 1629 nt, Artificial Sequence
  derived and/or modified sequence opt1 from VP1__Norovirus__AGT39206
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacagccccggggaggugcugcucaaccuggagcugggccccgagcucaacccguaccuggcccaccuggcccgcauguacaacggcuacgccgggggcauggagguccaggugaugcucgcggggaacgccuucaccgccggcaagcugguguucgccgccgucccgccccacuuccccguggagaaccuguccccgcagcagaucaccauguucccccacgugaucaucgacguccggacgcucgagcccgugcugcugccccucccggacgugcgcaacaacuucuuccacuacaaccagaaggacgaccccaagaugcggaucgucgcgaugcuguacacgccccugcgcuccaacggguccggcgacgacguguucaccgugagcugccggguccucacccgccccucccccgacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacauccccgcgccccucggcgugccggacuuccaggggcggguguucggcgucaucucccagcgcgacaagcacaacacgcccgggcacaacgagcccgccaaccgggcccacgacgccguggugcccaccuacaccgcccaguacaccccgaagcugggccagauccagaucggcacguggcagaccgacgaccugaccgucaaccagcccgugaaguucacccccguggggcucaacgacacggaccacuucaaccagugggucgugccccgcuacgccggcgcccugaaccugaacaccaaccucgcgccgagcguggcccccgucuuccccggggagcggcugcuguucuuccgcagcuacaucccccucaagggcggguacggcaccccggccaucgacugccugcugccccaggagugggugcagcacuucuaccaggaggccgcgcccuccaugagcgagguggcccucguccgguacaucaaccccgacaccggccgcgcccuguucgaggccaagcugcaccgggccggguucaugacgguguccagcaacaccuccgcgccgguggucgugcccgccaacggcuacuuccgcuucgacagcugggugaaccaguucuacucccucgcccccauggggaccggcaacgggcggcgccgcauccaguga

SEQ ID NO: 9622 - RNA, 1623 nt, Artificial Sequence
  derived and/or modified sequence opt1 from VP1__Norovirus__AHF45991
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccuccacccaggaguacaccaugaaccuggccagccagaacuggaacaacuacgacccgacggaggagauccccgcgccccugggcacccccgacuucgugggcaagauccaggggguccucacccagaccacgcggcgggacggcagcacccgcgggcacaaggccaccguguccaccggcagcgugcacuucacgccgaagcuggggcggauccaguucuccaccgacaccagcaacgacuucgagaccggccagaacacgcgcuucacccccgucggcguggugcaggacggguccaccacccaccagaacgagccccagcaguggguccugcccaacuacagcggccgggacucccacaacgugcaccucgccccggccguggcccccagcuuccccggggagcagcugcuguucuuccgcuccacgaugcccggcugcagcggguacccgaacaugaaccucgacugccugcugccccaggaguggguccagcacuucuaccaggaggccgcgcccgcccaguccgacguggcccuccugcgguucgugaaccccgacaccggccgcguccuguucgagugcaagcuccacaagagcggcuacgugaccguggcccacaccgggcagcacgaccuggucaucccgcccaacggcuacuuccgguucgacuccugggugaaccaguucuacacccuggcgcccauggggaacggcacggggcgccgccgggcccucuga

SEQ ID NO: 9623 - RNA, 1623 nt, Artificial Sequence; identical to SEQ ID NO: 8842
  derived and/or modified sequence opt1 from VP1__Norovirus__AHF45993

SEQ ID NO: 9624 - RNA, 1623 nt, Artificial Sequence; identical to SEQ ID NO: 9499
  derived and/or modified sequence opt1 from VP1__Norovirus__AHF45997

SEQ ID NO: 9625 - RNA, 1623 nt, Artificial Sequence; identical to SEQ ID NO: 9499
  derived and/or modified sequence opt1 from VP1__Norovirus__AHF45999

SEQ ID NO: 9626 - RNA, 1623 nt, Artificial Sequence; identical to SEQ ID NO: 9499
  derived and/or modified sequence opt1 from VP1__Norovirus__AHF46001

SEQ ID NO: 9627 - RNA, 1617 nt, Artificial Sequence
  derived and/or modified sequence opt1 from VP1__Norovirus__AHH44876
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccaucagcccccggaacgcgcccggggagauccugugguccgcgccccugggcccggaccucaaccccuaccugucccaccuggcccgcauguacaacggcuacgccgggggcuucgagguccagguggugcucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagcgccgugaacaucugcacguuccggggcgacgugacccacgucuccgacaagaccuucgccaugaaccuggcgagccccaacuggaacaacuacgaccccaccgaggacaucccggcgccccugggcacgcccgacuucguggggcgcauccacggcaugcucacccagaccacccggcgcgacggggccacgcggggccacaaggccaccguguccaccgggggcgccgacuucacccccaagcugggcagcguccgcuacaucacggacaccaccgacgaccuggaggugcgggagaacaccaaguucacgccgaucggggugcuccacagcuccggcgagcaccgcgccgagcccgaccaguggcggcugcccgaguacagcgggcgcaacguccacaacgugcaccuggcccccgccguggccccgaccuuccccggcgagcagcuccuguucuuccgguccgcgcugcccgggugcggcggcuaccccaacaccgaccucgacugccugcugccgcaggaguggguccagcacuucuaccaggaggccgcccccgcccagagcgacguggcccuccugcgcuucgugaaccccgacaccgggcgcguccuguucgagugcaagcuccacaaguccggcuacgugacgguggcgcacaccgggccccacgaccuggucaucccgcccaacggcuacuuccgguucgacagcugggugaaccaguucuacacccuggcccccauggggaacggcaccggccgccggcgcgcccucuga

SEQ ID NO: 9628 - RNA, 1617 nt, Artificial Sequence
  derived and/or modified sequence opt1 from VP1__Norovirus__AHH44877
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccaucagcccccggaacgcgcccggggagauccugugguccgcgccccugggcccggaccucaaccccuaccugucccaccuggcccgcauguacaacggcuacgccgggggcuucgagguccagguggugcucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaaggacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccgugcugacgguggaggagaugaccaacagccgguuccccaucccccuggagaagcuguucaccggccccuccagcgccuucgucgugcagccgcagaacgggcgcugcaccacggacggcguccuccuggggaccacccagcucuccgccgugaacaucugcaccuuccggggcgacgugacgcacgucgccggcgacaccuucgcgaugaaccuggccagccugaacuggaacaacuacgaccccaccgaggagacccccgccccgcucgggacgcccgacuucgugggccgcauccacgggaugcugacccagaccacccgguccgacggcgccacgcgcgcccacaaggcgaccgugagcaccgggggcgccgacuucacccccaagcugggcagcguccgguacuccacggacaccagcggggaccucgaggugcgcgagaacaccaaguucacccccaucggcgugcugcacuccagcggggagcggcgcgccgagccggagcaguggcggcugcccgaguacuccggccgcaacguccacaacgugcaccucgcccccgcgguggcccccacguucccgggggagcagcugcuguucuuccggagcaccaugcccggcugcggcggguaccccaacauggaccucgacugccugcugccccaggaguggguccagcacuucuaccaggaggccgccccggcccaguccgacguggcgcuccugcgcuucgugaaccccgacaccggccgcguccuguucgagugcaagcuccacaagagcggguacgugaccguggcccacacgggcccccacgaccuggucaucccgcccaacggguacuuccgguucgacuccugggugaaccaguucuacacccuggcccccaugggcaacggcaccgggcgccggcgcgcccucuga

SEQ ID NO: 9629 - RNA, 1617 nt, Artificial Sequence
  derived and/or modified sequence opt1 from VP1__Norovirus__AHH44878
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccaucagcccccggaacgcgcccggggagauccugugguccgcgccccugggcccggaccucaaccccuaccugagccaccuggcccgcauguacaacggcuacgccgggggcuucgagguccagguggugcucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaaggacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagcgccgugaacaucugcaccuuccggggcgacgugacgcacgucgccggcgacaccuucgcgaugaaccuggccucccugaacuggaacaacuacgaccccaccgaggagacccccgccccgcucgggacgcccgacuucgugggccgcauccacgggaugcugacccagaccacccggagcgacggcgccacgcgcgcccacaaggcgaccgugagcaccgggggcgccgacuucacccccaagcugggcuccguccgguacagcacggacaccuccagcgaccucgaggugcgcgagaacaccaaguucacccccaucggggugcugcacuccagcggcgggcaccgggccgagccggaccaguggcgccugcccgaguacuccggccggaacguccacaacgugcaccucgcccccgcgguggcccccacguucccgggggagcagcugcuguucuuccgcagcaccaugcccggcugcggcggguaccccaacauggaccucgacugccugcugccccaggaguggguccagcacuucuaccaggaggccgccccggcccaguccgacguggcgcuccugcgguucgugaaccccgacaccggccgcguccuguucgagugcaagcuccacaagagcggguacgugaccguggcccacacgggcccccacgaccuggucaucccgcccaacggguacuuccgcuucgacuccugggugaaccaguucuacacccuggcccccaugggcaacggcaccgggcggcgccgggcccucuga

SEQ ID NO: 9630 - RNA, 1617 nt, Artificial Sequence
  derived and/or modified sequence opt1 from VP1__Norovirus__AHH44879
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccaucagcccccggaacgcgcccggggagauccugugguccgcgccccugggcccggaccucaaccccuaccugucccaccuggcccgcauguacaacggcuacgccgggggcuucgagguccagguggugcucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaaggacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccgugcugacgguggaggagaugaccaacagccgguuccccaucccccuggagaagcuguucaccggccccuccagcgccuucgucgugcagccgcagaacgggcgcugcaccacggacggcguccuccuggggaccacccagcucuccgccgugaacaucugcaccuuccggggcgacgugacgcacgucgccggcgacaccuucgcgaugaaccuggccagccugaacuggaacaacuacgaccccaccgaggagacccccgccccgcucgggacgcccgacuucgugggccgcauccacgggaugcugacccagaccacccgguccgacggcgccacgcgcgcccacaaggcgaccgugagcaccgggggcgccgacuucacccccaagcugggcagcguccgguacuccacggacaccagcuccgaccucgaggugcgcgagaacaccaaguucacccccaucggggugcugcacagcuccggcgggcaccgggccgagccggaccaguggcgccugcccgaguacagcggccggaacguccacaacgugcaccucgcccccgcgguggcccccacguucccgggggagcagcugcuguucuuccgcuccaccaugcccggcugcggcggguaccccaacauggaccucgacugccugcugccccaggaguggguccagcacuucuaccaggaggccgccccggcccagagcgacguggcgcuccugcgguucgugaaccccgacaccggccgcguccuguucgagugcaagcuccacaaguccggguacgugaccguggcccacacgggcccccacgaccuggucaucccgcccaacggguacuuccgcuucgacagcugggugaaccaguucuacacccuggcccccaugggcaacggcaccgggcggcgccgggcccucuga

SEQ ID NO: 9631 - RNA, 1617 nt, Artificial Sequence
  derived and/or modified sequence opt1 from VP1__Norovirus__AHH44880
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccaucagcccccggaacgcgcccggggagauccugugguccgcgccccugggcccggaccucaaccccuaccugucccaccuggcccgcauguacaacggcuacgccgggggcuucgagguccagguggugcucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaaggacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccgugcugacgguggaggagaugaccaacagccgguuccccaucccccuggagaagcuguucaccggccccuccagcgccuucgucgugcagccgcagaacgggcgcugcaccacggacggcguccuccuggggaccacccagcucuccgccgugaacaucugcaccuuccggggcgacgugacgcacgucgccggcgacaccuucgcgaugaaccuggccagccugaacuggaacaacuacgaccccaccgaggagacccccgccccgcucgggacgcccgacuucgugggccgcauccacgggaugcugacccagaccacccgguccgacggcgccacgcgcgcccacaaggcgaccgugagcaccgggggcgccgacuucacccccaagcugggcagcguccgguacuccacggacaccagcuccgaccucgaggugcgcgagaacaccaaguucacccccaucggggugcugcacagcuccggcgggcaccgggccgagccggaccaguggcgccugcccgaguacagcggccggaacguccacaacgugcaccucgcccccgcgguggcccccacguucccgggggagcagcugcuguucuuccgcuccaccaugcccggcugcggcggguaccccaacauggaccucgacugccugcugccccaggaguggguccagcacuucuaccaggagaccgccccggcccagagcgacguggcccuccugcgguucgugaaccccgacaccggccgcguccuguucgagugcaagcuccacaaguccggguacgugacgguggcgcacaccggcccccacgaccuggucaucccgcccaacggguacuuccgcuucgacagcugggugaaccaguucuacacccuggcccccaugggcaacggcaccgggcggcgccgggcccucuga

SEQ ID NO: 9632 - RNA, 1617 nt, Artificial Sequence
  derived and/or modified sequence opt1 from VP1__Norovirus__AHH44881
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccaucagcccccggaacgcgcccggggagauccugugguccgcgccccugggcccggaccucaaccccuaccugucccaccuggcccgcauguacaacggcuacgccgggggcuucgagguccagguggugcucgccgggaacgccuucaccgccggcaaggugaucuucgccgccgugccgcccaacuucccgacggaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugcgggcgaacaacgccggcgacgacguguucaccgucagcugccgcgugcugacccggcccuccccggacuucgacuucaucuuccucgugccgcccaccgucgagagccgcaccaagcccuucuccgugcccgugcugacggucgaggagaugaccaacagccgguuccccaucccccuggagaagcuguucaccggccccuccagcgccuucgugguccagccgcagaacgggcgcugcaccacggacggcgugcuccuggggaccacccagcucuccgccgugaacaucugcaccuuccggggcgacgucacgcacguggccggcgacaccuucgcgaugaaccuggccagccugaacuggaacaacuacgaccccaccgaggagacccccgccccgcucgggacgcccgacuucgugggccgcauccacgggaugcugacccagaccacccgguccgacggcgccacgcgcgcccacaaggcgaccgucagcaccgggggcgccgacuucacccccaagcugggcagcgugcgguacuccacggacaccagcuccgaccucgaggugcgcgagaacaccaaguucacccccaucgggguccugcacagcuccggcgggcaccgggccgagccggaccaguggcgccugcccgaguacagcggccggaacgugcacaacgugcaccucgcccccgcggucgcccccacguucccgggggagcagcugcuguucuuccgcuccaccaugcccggcugcggcggguaccccaacauggaccucgacugccugcugccccaggagugggugcagcacuucuaccaggaggccgccccggcccagagcgacguggcgcuccugcgguucgucaaccccgacaccggccgcgugcuguucgagugcaagcuccacaaguccggguacgugaccgucgcccacacgggcccccacgaccuggugaucccgcccaacggguacuuccgcuucgacagcugggugaaccaguucuacacccuggcccccaugggcaacggcaccgggcggcgccgggcccucuga

SEQ ID NO: 9633 - RNA, 1617 nt, Artificial Sequence
  derived and/or modified sequence opt1 from VP1__Norovirus__AHH44884
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccaucagcccccggaacgcgcccggggagauccugugguccgcgccccugggcccggaccucaaccccuaccugucccaccuggcccgcauguacaacggcuacgccgggggcuucgagguccagguggugcucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaucaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucaccguccccgugcugacgguggacgagaugaccaacucccgguuccccaucccccuggagaagcuguucaccggccccagcuccgccuucgucgugcagccgcagaacgggcgcugcaccacggacggcguccuccuggggaccacccagcucagcgccgugaacaucugcaccuuccggggcgacgugacgcacgucuccgacaagaccuucgccaugaaccuggcgagccccaacuggaacaacuacgaccccaccgaggagaucccggcgccccugggcacccccgacuucguggggcgcauccacggcaugcucacgcagaccacccggcgcgacggggccacccggggccacaaggccacgguguccaccgggggcgccgacuucacccccaagcugggcagcguccgcuacaucaccgacacgaccgacgaccuggaggugcgggagaacaccaaguucaccccgaucggggugcuccacagcuccggcgagcaccgcgccgagcccgaccaguggcggcugcccgaguacagcgggcgcaacguccacaacgugcaccuggcccccgccguggccccgacguuccccggcgagcagcuccuguucuuccgguccgcgcugcccgggugcggcggcuaccccaacaccgaccucgacugccugcugccgcaggaguggguccagcacuucuaccaggaggccgcccccgcccagagcgacguggcccuccugcgcuucgugaaccccgacaccgggcgcguccuguucgagugcaagcuccacaaguccggcuacgugaccguggcgcacacggggccccacgaccuggucaucccgcccaacggcuacuuccgguucgacagcugggugaaccaguucuacacccuggcccccauggggaacggcaccggccgccggcgcgcccucuga

SEQ ID NO: 9634 - RNA, 1620 nt, Artificial Sequence
  derived and/or modified sequence opt1 from VP1__Norovirus__AHH44886
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccggggccuucgucgugcagccccagaacggccgcugcaccacggacgggguccuccugggcaccacccagcucagccccgugaacaucugcaccuuccggggcgaccugacgcacuucaccgggaccuccgaguacgccaugaaccuggccagccagaacuggaacaacuacgacccgaccgaggagauccccgcgccccucggcgcccccgacuucguggggaagauccgcggcaugcugacgcagaccacccggcgcgacggguccacccggggccaccgcgccacgcugagcaccggcagcgcccacuucaccccgaagcucggguccauccgguucagcaccgacacgaacaacgacuucgaggccggccagaacaccaaguucacccccgucgggguguuccaggagggcgacaaccaccagaacgagccccagcagugggugcugcccaacuacuccggggcgaccgcccacaacguccaccuggccccggccguggcgcccgccuuccccggcgagcagcuccuguucuuccgcagcacgaugcccggcugcgggggcuacccgaacaugaaccuggacugccuccugccccaggagugggugcagcacuucuaccaggaggccgcccccgcccaguccgacgucgcgcugcuccgguucgugaaccccgacaccagccgcgugcuguucgagugcaagcugcacaaguccggguacgucaccguggcccacaccggccagcacgaccucgugaucccgcccaacggguacuuccgguucgacagcugggucaaccaguucuacacgcuggcccccaugggcaacggcaccgggcgccgccgggcccuguga

SEQ ID NO: 9635 - RNA, 1620 nt, Artificial Sequence
  derived and/or modified sequence opt1 from VP1__Norovirus__AHH44888
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccggggccuucgucgugcagccccagaacggccgcugcaccacggacgggguccuccugggcaccacccagcucagccccgugaacaucugcaccuuccggggcgaccugacgcacuucaccgggaccuccgaguacgccaugaaccuggccagccagaacuggaacaacuacgacccgaccgaggagauccccgcgccccucggcgcccccgacuucguggggaagauccgcggcaugcugacgcagaccacccggcgcgacggguccacccggggccaccgcgccacgcugagcaccggcagcgcccacuucaccccgaagcucgggaacauccgguucuccaccgacacgaacaacgacuucgaggccggccagaacaccaaguucacccccgucgggguguuccaggagggcgacaaccaccagaacgagccccagcagugggugcugcccaacuacagcggggcgaccgcccacaacguccaccuggccccggccguggcgcccgccuuccccggcgagcagcuccuguucuuccgcuccacgaugcccggcugcgggggcuacccgaacaugaaccuggacugccuccugccccaggagugggugcagcacuucuaccaggaggccgcccccgcccagagcgacgucgcgcugcuccgguucgugaaccccgacaccucccgcgugcuguucgagugcaagcugcacaagagcggguacgucaccguggcccacaccggccagcacgaccucgugaucccgcccaacggguacuuccgguucgacuccugggucaaccaguucuacacgcuggcccccaugggcaacggcaccgggcgccgccgggcccuguga

SEQ ID NO: 9636 - RNA, 1620 nt, Artificial Sequence
  derived and/or modified sequence opt1 from VP1__Norovirus__AHH44889
augaagauggccagcaacgacgccucccccagcgacggcuccgcggccaaccuggugccggaggucagcaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucgucguggacgugcggcagcuggagcccguccucaucccgcugcccgacgugcgcaacaacuucuaccacuacaaccagagcaaggaccccaccaucaagcugaucgccaugcucuacacgccccugcgggcgaacaacgccggcgaggacguguucaccgucuccugccgcgugcugacccggccgagccccgacuucgacuucaucuuccucgugccgcccaccgucgagucccgcagcaagcccuucaccgugcccauccugacgguggaggagaugaccaacucccgguuccccaucccccuggagaagcuguucaccggcccgagcggggccuucgucgugcagccccagaacggccgcugcaccacggacgggguccuccugggcaccacccagcucucccccgugaacaucugcaccuuccggggcgaccugacgcacuucaccgggaccagcgaguacgccaugaaccuggccucccagaacuggaacaacuacgacccgaccgaggagauccccgcgccccucggcgcccccgacuucguggggaagauccgcggcaugcugacgcagaccacccggcgcgacgggagcacccggggccaccgcgccacgcugagcaccggcuccgcccacuucaccccgaagcucgggagcauccgguucuccaccgacacgaacaacgacuucgaggccggccagaacaccaaguucacccccgucgggaucuuccaggagggcgacaaccaccagaacgagccccagcagugggugcugcccaacuacagcggggcgaccgcccacaacgugcaccuggccccggccgucgcgcccgccuuccccggcgagcagcuccuguucuuccgcuccacgaugcccggcugcgggggcuacccgaacaugaaccuggacugccuccugccccaggagugggugcagcacuucuaccaggaggccgcccccgcccagagcgacguggcgcugcuccgguucgucaaccccgacaccucccgcgugcuguucgagugcaagcugcacaagagcggguacgugaccgucgcccacaccggccagcacgaccucgugaucccgcccaacggguacuuccgguucgacuccugggugaaccaguucuacacgcuggcccccaugggcaacggcaccgggcgccgccgggcccuguga

SEQ ID NO: 9637 - RNA, 1620 nt, Artificial Sequence; identical to SEQ ID NO: 9635
  derived and/or modified sequence opt1 from VP1__Norovirus__AHH44890

SEQ ID NO: 9638 - RNA, 1620 nt, Artificial Sequence; identical to SEQ ID NO: 9635
  derived and/or modified sequence opt1 from VP1__Norovirus__AHH44891

SEQ ID NO: 9639 - RNA, 1620 nt, Artificial Sequence; identical to SEQ ID NO: 9635
  derived and/or modified sequence opt1 from VP1__Norovirus__AHH44893

SEQ ID NO: 9640 - RNA, 1620 nt, Artificial Sequence
  derived and/or modified sequence opt1 from VP1__Norovirus__AHH44894
augaagauggccagcaacgacgccucccccagcgacggcuccgcggccaaccuggugccggaggucagcaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucgucguggacgugcggcagcuggagcccguccucaucccgcugcccgacgugcgcaacaacuucuaccacuacaaccagagcaaggaccccaccaucaagcugaucgccaugcucuacacgccccugcgggcgaacaacgccggcgaggacguguucaccgucuccugccgcgugcugacccggccgagccccgacuucgacuucaucuuccucgugccgcccaccgucgagucccgcagcaagcccuucaccgugcccauccugacgguggaggagaugaccaacucccgguuccccaucccccuggagaagcuguucaccggcccgagcggggccuucgucgugcagccccagaacggccgcugcaccacggacgggguccuccugggcaccacccagcucucccccgugaacaucugcaccuuccggggcgaccugacgcacuucaccgggaccagcgaguacgccaugaaccuggccucccagaacuggaacaacuacgacccgaccgaggagauccccgcgccccucggcgcccccgacuucguggggaagauccgcggcaugcugacgcagaccacccggcgcgacgggagcacccggggccaccgcgccacgcugagcaccggcuccgcccacuucaccccgaagcucgggagcauccgguucuccaccgacacgaacaacgacuucgaggccagccagaacaccaaguucacccccgucggcguguuccaggagggggacaaccaccagaacgagccccagcagugggugcugcccaacuacuccggcgcgaccgcccacaacguccaccuggccccggccguggcgcccgccuuccccggggagcagcuccuguucuuccgcagcacgaugcccggcugcggcggguacccgaacaugaaccuggacugccuccugccccaggagugggugcagcacuucuaccaggaggccgcccccgcccaguccgacgucgcgcugcuccgguucgugaaccccgacaccagccgcgugcuguucgagugcaagcugcacaaguccggcuacgucaccguggcccacaccgggcagcacgaccucgugaucccgcccaacggcuacuuccgguucgacagcugggucaaccaguucuacacgcuggcccccauggggaacggcaccggccgccgccgggcccuguga

SEQ ID NO: 9641 - RNA, 1620 nt, Artificial Sequence
  derived and/or modified sequence opt1 from VP1__Norovirus__AHH44895
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccggggccuucgucgugcagccccagaacggccgcugcaccacggacgggguccuccugggcaccacccagcucagccccgugaacaucugcaccuuccggggcgaccugacgcacuucaccgggaccuccgaguacgccaugaaccuggccagccagaacugggacaacuacgacccgaccgaggagauccccgcgccccucggcgcccccgacuucguggggaagauccgcggcaugcugacgcagaccacccggcgcgacggguccacccggggccaccgcgccacgcugagcaccggcagcgcccacuucaccccgaagcucgggaacauccgguucuccaccgacacgaacaacgacuucgaggccggccagaacaccaaguucacccccgucgggguguuccaggagggcgacaaccaccagaacgagccccagcagugggugcugcccaacuacagcggggcgaccgcccacaacguccaccuggccccggccguggcgcccgccuuccccggcgagcagcuccuguucuuccgcuccacgaugcccggcugcgggggcuacccgaacaugaaccuggacugccuccugccccaggagugggugcagcacuucuaccaggaggccgcccccgcccagagcgacgucgcgcugcuccgguucgugaaccccgacaccucccgcgugcuguucgagugcaagcugcacaagagcggguacgucaccguggcccacaccggccagcacgaccucgugaucccgcccaacggguacuuccgguucgacuccugggucaaccaguucuacacgcuggcccccaugggcaacggcaccgggcgccgccgggcccuguga

SEQ ID NO: 9642 - RNA, 1620 nt, Artificial Sequence; identical to SEQ ID NO: 9635
  derived and/or modified sequence opt1 from VP1__Norovirus__AHH44896

SEQ ID NO: 9643 - RNA, 1620 nt, Artificial Sequence; identical to SEQ ID NO: 9635
  derived and/or modified sequence opt1 from VP1__Norovirus__AHH44897

SEQ ID NO: 9644 - RNA, 1620 nt, Artificial Sequence; identical to SEQ ID NO: 9635
  derived and/or modified sequence opt1 from VP1__Norovirus__AHH44899

SEQ ID NO: 9645 - RNA, 1620 nt, Artificial Sequence
  derived and/or modified sequence opt1 from VP1__Norovirus__AHH44900
augaagauggccagcaacgacgccucccccagcgacggcuccgcggccaaccuggugccggaggucaacaacgaggugauggcccucgagcccguggucggggccaccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggccaacaacgcgggcgaggacguguucaccgucagcugccgcgugcugacccggccgucccccgacuucgacuucaucuuccucgugagccccaccgucgagucccgcagcaagcccuucacggugccgauccugaccguggaggagaugaccaacucccgguuccccaucccccuggagaagcuguucaccggccccagcggggccuucgucgugcagccgcagaacggccgcugcacgaccgacgggguccuccugggcaccacccagcucucccccgugaacaucugcacguuccggggcgaccugacccacuucaccgggaccagcgaguacgccaugaaccuggccucccagaacuggaacaacuacgaccccacggaggagaucccggcgccccucggcgcccccgacuucguggggaagauccgcggcaugcugacccagaccacccggcgcgacgggagcacgcggggccaccgcgccacccugagcaccggcuccgcccacuucacccccaagcucgggaacauccgguucagcacggacaccaacaacgacuucgaggccggccagaacaccaaguucaccccggucgggguguuccaggagggcgacaaccaccagaacgagccccagcagugggugcugcccaacuacuccggggccacggcgcacaacguccaccuggcccccgccguggccccggcguuccccggcgagcagcuccuguucuuccgcagcaccaugcccggcugcgggggcuaccccaacaugaaccuggacugccuccugccgcaggagugggugcagcacuucuaccaggaggccgcccccgcccaguccgacgucgcccugcuccgguucgugaaccccgacaccagccgcgugcuguucgagugcaagcugcacaaguccggguacgucaccguggcgcacacgggccagcacgaccucgugaucccgcccaacggguacuuccgguucgacagcugggucaaccaguucuacacccuggcccccaugggcaacggcaccgggcgccgccgggcccuguga

SEQ ID NO: 9646 - RNA, 1620 nt, Artificial Sequence; identical to SEQ ID NO: 9635
  derived and/or modified sequence opt1 from VP1__Norovirus__AHH44902

SEQ ID NO: 9647 - RNA, 1620 nt, Artificial Sequence
  derived and/or modified sequence opt1 from VP1__Norovirus__AHH44904
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugagccccaccgucgagucccgcagcaagcccuucaccgugccgauccugacgguggaggagaugaccaacucccgguuccccaucccccuggagaagcuguucaccggccccagcggggccuucgucgugcagccgcagaacggccgcugcaccacggacgggguccuccugggcaccacccagcucucccccgugaacaucugcaccuuccggggcgaccugacgcacuucaccgggaccagcgaguacgccaugaaccuggccucccagaacuggaacaacuacgaccccaccgaggagaucccggcgccccucggcgcccccgacuucguggggaagauccgcggcaugcugacgcagaccacccggcgcgacgggagcacccggggccaccgcgccacgcugagcaccggcuccgcccacuucacccccaagcucgggaacauccgguucagcaccgacacgaacaacgacuucgaggccggccagaacaccaaguucaccccggucgggguguuccaggagggcgacaaccaccagaacgagccccagcagugggugcugcccaacuacuccggggcgaccgcccacaacguccaccuggcccccgccguggcgccggccuuccccggcgagcagcuccuguucuuccgcagcacgaugcccggcugcgggggcuaccccaacaugaaccuggacugccuccugccgcaggagugggugcagcacuucuaccaggaggccgcccccgcccaguccgacgucgcgcugcuccgguucgugaaccccgacaccagccgcgugcuguucgagugcaagcugcacaaguccggguacgucaccguggcccacaccggccagcacgaccucgugaucccgcccaacggguacuuccgguucgacagcugggucaaccaguucuacacgcuggcccccaugggcaacggcaccgggcgccgccgggcccuguga

SEQ ID NO: 9648 - RNA, 1620 nt, Artificial Sequence; identical to SEQ ID NO: 9635
  derived and/or modified sequence opt1 from VP1__Norovirus__AHH44905

SEQ ID NO: 9649 - RNA, 1620 nt, Artificial Sequence
  derived and/or modified sequence opt1 from VP1__Norovirus__AHH44906
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccuacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcgaccugacgcacuucgccggcaccagcgaguacgccaugaaccuggcgucccagaacuggaccaacuacgacccgaccgaggagauccccgcgccccucggggcccccgacuucgugggcaagauccgcgggguccugacgcagaccacccggggcgacgggagcacccgcggccaccgggccacgcugagcaccggcuccgcccacuucaccccgaagcucgggagcgugcgcuucuccaccgacacgaacaacgacuucgaggccggccagaacaccaaguucacccccgugggggucuuccaggacggcgacaaccaccagaacgagccccagcagugggugcugcccaacuacagcggggccaccgcccacaacgugcaccuggccccggcggucgcccccgccuuccccggcgagcagcuccuguucuuccgguccacgaugcccggcugcagcggguacccgaacaugaaccuggacugccuccugccccaggagugggugcagcacuucuaccaggaggccgcccccgcgcaguccgacguggcccugcuccgcuucgucaaccccgacaccagccgggugcuguucgagugcaagcugcacaaguccggcuacgugaccgucgcccacaccgggcagcacgaccucgugaucccgcccaacggcuacuuccgcuucgacagcugggugaaccaguucuacacgcuggcccccauggggaacggcaccggccggcgccgcgcccuguga

SEQ ID NO: 9650 - RNA, 1620 nt, Artificial Sequence
  derived and/or modified sequence opt1 from VP1__Norovirus__AHH44907
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaaguucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccggggccuucgucgugcagccccagaacggccgcugcaccacggacgggguccuccugggcaccacccagcucagccccgugaacaucugcaccuuccggggcgaccugacgcacuucgccgggacccacgaguacgccaugaaccuggcgucccagaacuggaacaacuacgacccgaccgaggagauccccgcgccccucggcgcccccgacuucguggggaagauccgcggcguccugacccagacgacccggcgcgacgggagcacccggggccaccgcgccacccuguccacgggcagcgcccacuucaccccgaagcucgggagcauccgguucuccaccgacaccaacaacgacuucgaggccggccagaacacgaaguucacccccguggggguguuccaggacggcgacaaccaccagaacgagccccagcaguggguccugcccaacuacagcggggccaccgcccacaacgugcaccuggccccggcgguggcccccgccuuccccggcgagcagcuccuguucuuccgcuccaccaugcccggcugcagcggguacccgaacaugaaccuggacugccuccugccccaggaguggguccagcacuucuaccaggaggccgcccccgcgcaguccgacguggcccugcuccgguucgugaaccccgacacgagccgcguccuguucgagugcaagcugcacaaguccggcuacgugaccguggcccacaccgggcagcacgaccucgucaucccgcccaacggcuacuuccgguucgacagcugggugaaccaguucuacacccuggcccccauggggaacggcacgggccgccgcugcgcccuguga

SEQ ID NO: 9651 - RNA, 1620 nt, Artificial Sequence
  derived and/or modified sequence opt1 from VP1__Norovirus__AHH44908
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcgaccugacgcacuucgccggcaccagcgaguacgccaugaaccuggcgucccagaacuggaccaacuacgacccgaccgaggagauccccgcgccccucggggcccccgacuucgugggcaagauccgcgggguccugacgcagaccacccggggcgacgggagcacccgcggccaccgggccacgcugagcaccggcuccgcccacuucaccccgaagcucgggagcgugcgcuucuccaccgacacgaacaacgacuucgaggccggccagaacaccaaguucacccccgugggggucuuccaggacggcgacaaccaccagaacgagccccagcagugggugcugcccaacuacagcggggccaccgcccacaacgugcaccuggccccggcggucgcccccgccuuccccggcgagcagcuccuguucuuccgguccacgaugcccggcugcagcggguacccgaacaugaaccuggacugccuccugccccaggagugggugcagcacuucuaccaggaggccgcccccgcgcaguccgacguggcccugcuccgcuucgucaaccccgacaccagccgggugcuguucgagugcaagcugcacaaguccggcuacgugaccgucgcccacaccgggcagcacgaccucgugaucccgcccaacggcuacuuccgcuucgacagcugggugaaccaguucuacacgcuggcccccauggggaacggcaccggccggcgccgcgcccuguga

SEQ ID NO: 9652 - RNA, 1620 nt, Artificial Sequence
  derived and/or modified sequence opt1 from VP1__Norovirus__AHH44909
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccugggaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccggcgccuucgucgugcagccccagaacgggcgcugcaccacggacggcguccuccuggggaccacccagcucagccccgugaacaucugcaccuuccggggcgaccugacgcacuucgccggcacccacgaguacgccaugaaccuggcgucccagaacuggaacaacuacgacccgaccgaggagauccccgcgccccucggggcccccgacuucgugggcaagauccgcgggguccugacccagacgacccggcgcgacggcagcacccgggggcaccgcgccacccuguccacgggcagcgcccacuucaccccgaagcucggcagcauccgguucuccaccgacaccaacaacgacuucgaggccgggcagaacacgaaguucacccccgugggcguguuccaggacggggacaaccaccagaacgagccccagcaguggguccugcccaacuacagcggcgccaccgcccacaacgugcaccuggccccggcgguggcccccgccuuccccggggagcagcuccuguucuuccgcuccaccaugcccggcugcagcggcuacccgaacaugaaccuggacugccuccugccccaggaguggguccagcacuucuaccaggaggccgcccccgcgcaguccgacguggcccugcuccgguucgugaaccccgacacgagccgcguccuguucgagugcaagcugcacaaguccggguacgugaccguggcccacaccggccagcacgaccucgucaucccgcccaacggguacuuccgguucgacagcugggugaaccaguucuacacccuggcccccaugggcaacgggacgggccgccgccgggcccuguga

SEQ ID NO: 9653 - RNA, 1620 nt, Artificial Sequence
  derived and/or modified sequence opt1 from VP1__Norovirus__AHH44911
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccggggccuucgucgugcagccccagaacggccgcugcaccacggacgggguccuccugggcaccacccagcucagccccgugaacaucugcaccuuccggggcgaccugacgcacuucgccgggacccacgaguacgccaugaaccuggcgucccagaacuggaacaacuacgacccgaccgaggagauccccgcgccccucggcgcccccgacuucguggggaagauccgcggcguccugacccagacgacccggcgcgacgggagcacccggggccaccgcgccacccuguccacgggcagcgcccacuucaccccgaagcucgggagcauccgguucuccaccgacaccaacaacgacuucgaggccggccagaacacgaaguucacccccguggggguguuccaggacggcgacaaccaccagaacgagccccagcaguggguccugcccaacuacagcggggccaccgcccacaacgugcaccuggccccggcgguggcccccgccuuccccggcgagcagcuccuguucuuccgcuccaccaugcccggcugcagcggguacccgaacaugaaccuggacugccuccugccccaggaguggguccagcacuucuaccaggaggccgcccccgcgcaguccgacguggcccugcuccgguucgugaaccccgacacgagccgcguccuguucgagugcaagcugcacaaguccggcuacgugaccguggcccacaccgggcagcacgaccucgucaucccgcccaacggcuacuuccgguucgacagcugggugaaccaguucuacacccuggcccccauggggaacggcacgggccgccgccgggcccuguga

SEQ ID NO: 9654 - RNA, 1620 nt, Artificial Sequence
  derived and/or modified sequence opt1 from VP1__Norovirus__AHH44912
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccggggccuucgucgugcagccccagaacggccgcugcaccacggacgggguccuccugggcaccacccagcucagccccgugaacaucugcaccuuccggggcgaccugacgcacuucgccgggacccacgaguacgccaugaaccuggcgucccagaacuggagcaacuacgacccgaccgaggagauccccgcgccccucggcgcccccgacuucguggggaagauccgcggcguccugacccagacgacccgcggggacggcuccacccggggccaccgggccacccugagcacggggagcgcccacuucaccccgaagcucggcuccauccgcuucagcaccgacaccaacaacgacuucgaggccgggcagaacacgaaguucacccccgugggcguguuccaggacggggacaaccaccagaacgagccccagcaguggguccugcccaacuacuccggcgccaccgcccacaacgugcaccuggccccggcgguggcccccgccuuccccggcgagcagcuccuguucuuccggagcaccaugcccgggugcuccggcuacccggacaugaaccuggacugccuccugccccaggaguggguccagcacuucuaccaggaggccgcccccgcgcagagcgacguggcccugcuccgcuucgugaaccccgacacgucccggguccuguucgagugcaagcugcacaagagcggguacgugaccguggcccacaccggccagcacgaccucgucaucccgcccaacggguacuuccgcuucgacuccugggugaaccaguucuacacccuggcccccaugggcaacggcacggggcggcgccgcgcccuguga

SEQ ID NO: 9655 - RNA, 1620 nt, Artificial Sequence
  derived and/or modified sequence opt1 from VP1__Norovirus__AHH44913
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcgaccugacgcacuucgccggcaccagcgaguacgccaugaaccuggcgucccagaacuggaccaacuacgacccgaccgaggagauccccgcgccccucggggcccccgacuucgugggcaagauccgcgggguccugacgcagaccacccggcgcgacggcagcacccgggggcaccgcgccacgcugagcaccggcuccgcccacuucaccccgaagcucggcagcauccgguucuccaccgacacgaacaacgacuucgaggccgggcagaacaccaaguucacccccgugggcguguuccaggacggggacaaccaccagaacgagccccagcaguggguccugcccaacuacagcggcgccaccgcccacaacgugcaccuggccccggcgguggcccccgccuuccccggggagcagcuccuguucuuccgcuccacgaugcccggcugcagcggcuacccgaacaugaaccuggacugccuccugacccaggaguggguccagcacuucuaccaggaggccgcccccgcgcaguccgacguggcccugcuccgguucgugaaccccgacaccagccgcguccuguucgagugcaagcugcacaaguccggguacgugaccguggcccacacgggccagcacgaccucgucaucccgcccaacggguacuuccgguucgacagcugggugaaccaguucuacacccuggcccccaugggcaacgggaccggccgccgccgggcccuguga

SEQ ID NO: 9656 - RNA, 1620 nt, Artificial Sequence
  derived and/or modified sequence opt1 from VP1__Norovirus__AHH44914
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcgaccugacgcacuucgccggcacccacgaguacgccaugaaccuggcgagccagaacuggaccaacuacgacccgaccgaggagauccccgcgccccucggggcccccgacuucgugggcaagauccgcgggguccugacgcagaccacccggggcgacggguccacccgcggccaccgggccacgcugagcaccggcagcgcccacuucaccccgaagcucggguccgugcgcuucagcaccgacacgaacaacgacuucgaggccggccagaacaccaaguucacccccgugggggucuuccaggacggcgacaaccaccagaacgagccccagcagugggugcugcccaacuacuccggggccaccgcccacaacgugcaccuggccccggcggucgcccccgccuuccccggcgagcagcuccuguucuuccggagcacgaugcccggcugcuccggguacccgaacaugaaccuggacugccuccugccccaggagugggugcagcacuucuaccaggaggccgcccccgcgcagagcgacguggcccugcuccgcuucgucaaccccgacaccucccgggugcuguucgagugcaagcugcacaagagcggcuacgugaccgucgcccacaccgggcagcacgaccucgugaucccgcccaacggcuacuuccgcuucgacuccugggugaaccaguucuacacgcuggcccccauggggaacggcaccggccggcgccgcgcccuguga

SEQ ID NO: 9657 - RNA, 1620 nt, Artificial Sequence
  derived and/or modified sequence opt1 from VP1__Norovirus__AHH44915
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcgaccugacgcacuucgccggcaccagcgaguacgccaugaaccuggcgucccagaacuggaccaacuacgacccgaccgaggagauccccgcgccccucggggcccccgacuucgugggcaagauccgcgggguccugacgcagaccacccggcgcgacggcagcacccgggggcaccgcgccacgcugagcaccggcuccgcccacuucaccccgaagcucggcagcauccgguucuccaccgacacgaacaacgacuucgaggccgggcagaacaccaaguucacccccgugggcguguuccaggacggggacaaccaccagaacgagccccagcaguggguccugcccaacuacagcggcgccaccgcccacaacgugcaccuggccccggcgguggcccccgccuuccccggggagcagcuccuguucuuccgcuccacgaugcccggcugcagcggcuacccgaacaugaaccuggacugccuccugccccaggaguggguccagcacuucuaccaggaggccgcccccgcgcaguccgacguggcccugcuccgguucgugaaccccgacaccagccgcguccuguucgagugcaagcugcacaaguccggguacgugaccguggcccacaccggccagcacgaccucgucaucccgcccaacggguacuuccgguucgacagcugggugaaccaguucuacacgcuggcccccaugggcaacgggaccggccgccgccgggcccuguga

SEQ ID NO: 9658 - RNA, 1623 nt, Artificial Sequence; identical to SEQ ID NO: 9445
  derived and/or modified sequence opt1 from VP1__Norovirus__AID60853

SEQ ID NO: 9659 - RNA, 1623 nt, Artificial Sequence; identical to SEQ ID NO: 9493
  derived and/or modified sequence opt1 from VP1__Norovirus__AID60855

SEQ ID NO: 9660 - RNA, 1623 nt, Artificial Sequence; identical to SEQ ID NO: 9493
  derived and/or modified sequence opt1 from VP1__Norovirus__AID60857

SEQ ID NO: 9661 - RNA, 1623 nt, Artificial Sequence; identical to SEQ ID NO: 9493
  derived and/or modified sequence opt1 from VP1__Norovirus__AID60859

SEQ ID NO: 9662 - RNA, 1623 nt, Artificial Sequence
  derived and/or modified sequence opt1 from VP1__Norovirus__AID60861
augaagauggccagcuccgacgccaaccccagcgacggcuccgcggccagccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaucggcagcgccgacuucgccccgaagcugggccgggugcaguucgagaccgacacggaccacgacuucgaggccaaccagaacaccaaguucacccccgucggggugauccaggacggcuccaccacgcaccgcaacgagccccagcagugggugcugcccagcuacuccgggcggaacaccccgaacguccaccucgcccccgcgguggcccccaccuuccccggcgagcagcugcuguucuuccgcagcaccaugccggggugcuccggcuaccccaacauggaccucgacugccugcugccccaggagugggugcaguacuucuaccaggaggccgcccccgcgcagagcgacgucgcccuccugcgguucgugaacccggacacgggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggaccggccgccgccgggcccucuga

SEQ ID NO: 9663 - RNA, 1623 nt, Artificial Sequence
  derived and/or modified sequence opt1 from VP1__Norovirus__AID60863
augaagauggccagcuccgacgccaaccccagcgacggcuccgcggccagccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacaccccgaacguccaccucgcccccgcgguggcccccaccuuccccggcgagcagcugcuguucuuccgcagcacgaugccggggugcuccggcuaccccaacauggaccucgacugccugcugccccaggagugggugcaguacuucuaccaggaggccgcccccgcgcagagcgacgucgcccuccugcgguucgugaacccggacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgggcccucuga

SEQ ID NO: 9664 - RNA, 1623 nt, Artificial Sequence
  derived and/or modified sequence opt1 from VP1__Norovirus__AID60865
augaagauggccagcuccgacgccaaccccagcgacggcuccgcggccagccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacguggugaucgacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccacgacuucgagaccaaccagaacaccaaguucacgcccgucggggugauccaggacggcgggaccacccaccgcaacgagccccagcagugggugcugcccuccuacagcggccggaacaccccgaacguccaccucgcccccgccguggcgcccacguuccccggggagcagcugcuguucuuccgcuccaccaugccgggcugcagcggcuaccccaacauggaccucgacugccugcugccccaggagugggugcaguacuucuaccaggaggccgcccccgcccaguccgacgucgcgcuccugcgguucgugaacccggacaccgggcgcgugcuguucgagugcaagcuccacaagagcggcuacgucaccguggcccacaccgggcagcacgaccuggugaucccgcccaacggcuacuuccgguucgacuccugggucaaccaguucuacacgcuggcccccauggggaacggcaccggccgccgccgggcccucuga

SEQ ID NO: 9665 - RNA, 1623 nt, Artificial Sequence
  derived and/or modified sequence opt1 from VP1__Norovirus__AID60869
augaagauggccagcuccgacgccaaccccagcgacggcuccgcggccagccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcugcuggggaccacccagcucagccccgucaacaucugcaccuuccggggcgacgugacgcacaucaccggcucccacaacuacaccaugaaccuggccagccagaacuggagcaacuacgacccgaccgaggagauccccgcgccccuggggacgcccgacuucgugggcaagauccaggggguccucacccagaccacccgcacgaacggcuccacccgggggcacaaggccaccguguacgccggcagcgccaacuucgccccgaagcugggccgcgugcaguucgagaccgacacggaccacgaccuggaggccaaccagaacaccaaguucacccccgucggggugauccaggacggcaacaccacgcaccggaacgagccccagcagugggugcuccccuccuacagcgggcgcuccaccccgaacguccaccuggcgcccgccguggcccccaccuuccccggcgagcagcuccucuucuuccggagcaccaugccggggugcuccggcuaccccaacauggaccuggacugccugcucccccaggagugggugcaguacuucuaccaggaggccgcgcccgcccagagcgacgucgcccugcugcgcuucgugaacccggacacgggccggguccucuucgagugcaagcugcacaaguccggguacgugaccguggcccacaccggccagcacgaccuggugaucccgcccaacggguacuuccgcuucgacagcugggucaaccaguucuacacccucgcccccaugggcaacgggaccggccggcgccgcgcgcuguga

SEQ ID NO: 9666 - RNA, 1623 nt, Artificial Sequence
  derived and/or modified sequence opt1 from VP1__Norovirus__AID60871
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccacgccccuggagaagcuguucaccggcccguccagcgccuucgucgugcagccccagaacgggcgcugcaccaccgacggcgugcuccuggggaccacccagcucucccccgucaacaucugcacguuccggggcgacgugacccacaucaccggcagccgcaacuacaccaugaaccuggccucccagaacuggagcaacuacgacccgacggaggagauccccgcgccccuggggacccccgacuucgugggcaagauccaggggguccucacccagaccacgcggaccgacggcagcacccgcgggcacaaggccaccguguacacgggcuccgccgacuucgccccgaagcugggccgggugcaguucgagaccgacaccgaccacgacuucgaggccaaccagaacaccaaguucacgcccgucggggugauccaggacggcagcaccacccaccgcaacgagccccagcagugggugcugcccuccuacagcgggcggaacaccccgaacguccaccucgcccccgcgguggcccccacguuccccggcgagcagcugcuguucuuccgcuccaccaugccggggugcagcggcuaccccaacauggaccucgacugccugcugccccaggagugggugcaguacuucuaccaggaggccgcccccgcgcaguccgacgucgcccuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacgcuggcccccaugggcaacgggaccggccgccgccgggcccucuga

SEQ ID NO: 9667 - RNA, 1623 nt, Artificial Sequence
  derived and/or modified sequence opt1 from VP1__Norovirus__AID60875
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccacgccccuggagaagcuguucaccggccccagcuccgccuucgucgugcagccgcagaacgggcgcugcaccaccgacggcgugcuccuggggaccacccagcucagccccgucaacaucugcacguuccggggcgacgugacccacaucaccggcucccgcaacuacaccaugaaccuggccagccagaacuggagcaacuacgaccccacggaggagaucccggcgccccuggggacccccgacuucgugggcaagauccaggggguccucacccagaccacgcggaccgacggcuccacccgcgggcacaaggccaccguguacacgggcagcgccgacuucgcccccaagcugggccgggugcaguucgagaccgacaccgaccacgacuucgagaccaaccagaacacgaaguucaccccggucggggugauccaggacggcuccaccacccaccgcaacgagccccagcagugggugcugcccagcuacuccgggcggaacacgcccaacguccaccucgccccggccguggcgcccaccuuccccggcgagcagcugcuguucuuccgcagcaccaugcccgggugcuccggcuacccgaacauggaccucgacugccugcugccccaggagugggugcaguacuucuaccaggaggccgcccccgcccagagcgacgucgcgcuccugcgguucgugaaccccgacaccggccgcgugcuguucgagugcaagcuccacaaguccggguacgucaccguggcccacacgggccagcacgaccuggugaucccgcccaacggguacuuccgguucgagagcugggucaaccaguucuacacccuggcccccaugggcaacgggaccggccgccgccgggcccucuga

SEQ ID NO: 9668 - RNA, 1623 nt, Artificial Sequence
  derived and/or modified sequence opt1 from VP1__Norovirus__AID60877
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccacgccccuggagaagcuguucaccggccccagcuccgccuucgucgugcagccgcagaacgggcgcugcaccaccgacggcgugcuccuggggaccacccagcucagccccgucaacaucugcacguuccggggcgacgugacccacaucaccggcucccgcaacuacaccaugaaccuggccagccagaacuggagcaacuacgaccccacggaggagaucccggcgccccuggggacccccgacuucgugggcaagauccaggggguccucacccagaccacgcggaccgacggcuccacccgcgggcacaaggccaccguguacacgggcagcgccgacuucgcccccaagcugggccgggugcaguucgagaccgacaccgaccacgacuucgagaccaaccagaacacgaaguucaccccggucggggugauccaggacggcuccaccacccaccgcaacgagccccagcagugggugcugcccagcuacuccgggcggaacacgcccaacguccaccucgccccggccguggcgcccaccuuccccggcgagcagcugcuguucuuccgcagcaccaugcccgggugcuccggcuacccgaacauggaccucgacugccugcugccccaggagugggugcaguacuucuaccaggaggccgcccccgcccagagcgacgucgcgcuccugcgguucgugaaccccgacaccggccgcgugcuguucgagugcaagcuccacaaguccggguacgucaccguggcccacacgggccagcacgaccuggugaucccgcccaacggguacuuccgguucgacagcugggucaaccaguucuacacccuggcccccaugggcaacgggaccggccgccgccgggcccucuga

SEQ ID NO: 9669 - RNA, 1623 nt, Artificial Sequence; identical to SEQ ID NO: 9668
  derived and/or modified sequence opt1 from VP1__Norovirus__AID60879

SEQ ID NO: 9670 - RNA, 1623 nt, Artificial Sequence
  derived and/or modified sequence opt1 from VP1__Norovirus__AID60881
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccacgccccuggagaagcuguucaccggccccagcuccgccuucgucgugcagccgcagaacgggcgcugcaccaccgacggcgugcuccuggggaccacccagcucagccccgucaacaucugcacguuccggggcgacgugacccacaucaccggcucccgcaacuacaccaugaaccuggccagccagaacuggagcaacuacgaccccacggaggagaucccggcgccccuggggacccccgacuucgugggcaagauccaggggguccucacccagaccacgcggaccgacggcuccacccgcgggcacaaggccaccguguacacgggcagcgccgacuucgcccccaagcugggccgggugcaguucgagaccgacaccgaccacgacuucgagaccaaccagaacacgaaguucaccccggucggggugauccaggacggcuccaccacccaccgcaacgagccccagcagugggugcugcccagcuacuccgggcggaacacgcccaacguccaccucgccccggccguggcgcccaccuuccccggcgagcagcugcuguucuuccgcagcaccauccccgggugcuccggcuacccgaacauggaccucgacugccugcugccccaggagugggugcaguacuucuaccaggaggccgcccccgcccagagcgacgucgcgcuccugcgguucgugaaccccgacaccggccgcgugcuguucgagugcaagcuccacaaguccggguacgucaccguggcccacacgggccagcacgaccuggugaucccgcccaacggguacuuccgguucgacagcugggucaaccaguucuacacccuggcccccaugggcaacgggaccggccgccgccgggcccucuga

SEQ ID NO: 9671 - RNA, 1623 nt, Artificial Sequence
  derived and/or modified sequence opt1 from VP1__Norovirus__AID60883
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccaucagcccccggaacgcgcccggggagauccugugguccgcgccccugggcccggaccucaaccccuaccugagccaccuggcccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgacagcaccaucaagcugaucgccaugcucuacacgccccugcgggcgaacaacgccggcgacgacguguucaccgucuccugccgcgugcugacccggcccagcccggacuucgaccucaucuuccuggugccgcccaccgucgagucccgcaccaagcccuucagcgugcccgugcugacggucgaggagaugaccaacucccgguuccccacgccccucgagaagcuguucaccggccccagcuccgccuucgugguccagccgcagaacgggcgcugcaccaccgacggcgugcugcucgggaccacccagcugagccccgugaacaucugcacguuccggggcgacgucacccacaucaccggcucccgcaacuacaccaugaaccuggccagccagaacuggagcaacuacgaccccacggaggagaucccggcgccccucgggacccccgacuucgugggcaagauccagggggugcugacccagaccacgcggaccgacggcuccacccgcgggcacaaggccaccgucuacacgggcagcgccgacuucgcccccaagcugggccgggugcaguucgagaccgacaccgaccacgacuucgagaccaaccagaacacgaaguucaccccggugggggucauccaggacggcuccaccacccaccgcaacgagccccagcagugggugcuccccagcuacuccgggcggaacacgcccaacgugcaccuggccccggccgucgcgcccaccuuccccggcgagcagcuccuguucuuccgcagcaccauccccgggugcuccggcuacccgaacauggaccuggacugccugcucccccaggagugggugcaguacuucuaccaggaggccgcccccgcccagagcgacguggcgcugcugcgguucgucaaccccgacaccggccgcguccucuucgagugcaagcugcacaaguccggguacgugaccguggcccacacgggccagcacgaccuggugaucccgcccaacggguacuuccgguucgacagcugggugaaccaguucuacacccucgcccccaugggcaacgggaccggccgccgccgggcccuguga

SEQ ID NO: 9672 - RNA, 1623 nt, Artificial Sequence; identical to SEQ ID NO: 9668
  derived and/or modified sequence opt1 from VP1__Norovirus__AID60885

SEQ ID NO: 9673 - RNA, 1623 nt, Artificial Sequence
  derived and/or modified sequence opt1 from VP1__Norovirus__AID60887
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccacgccccuggagaagcuguucaccggcccguccagcgccuucgucgugcagccccagaacgggcgcugcaccaccgacggcgugcuccuggggaccacccagcucucccccgucaacaucugcacguuccggggcgacgugacccacaucaccggcagccgcaacuacaccaugaaccuggccucccagaacuggagcaacuacgacccgacggaggagauccccgcgccccuggggacccccgacuucgugggcaagauccaggggguccucacccagaccacgcggaccgacggcagcacccgcgggcacaaggccaccguguacacgggcuccgccgacuucgccccgaagcugggccgggugcaguucgagaccgacaccgaccacgacuucgagaccaaccagaacacgaaguucacccccgucggggugauccaggacggcagcaccacccaccgcaacgagccccagcagugggugcugcccuccuacagcgggcggaacacgccgaacguccaccucgcccccgccguggcgcccaccuuccccggcgagcagcugcuguucuuccgcuccaccaugccggggugcagcggcuaccccaacauggaccucgacugccugcugccccaggagugggugcaguacuucuaccaggaggccgcccccgcccaguccgacgucgcgcuccugcgguucgugaacccggacaccggccgcgugcuguucgagugcaagcuccacaagagcggguacgucaccguggcccacacgggccagcacgaccuggugaucccgcccaacggguacuuccgguucgacuccugggucaaccaguucuacacccuggcccccaugggcaacgggaccggccgccgccgggcccucuga

SEQ ID NO: 9674 - RNA, 1623 nt, Artificial Sequence
  derived and/or modified sequence opt1 from VP1__Norovirus__AID60889
augaagauggccagcuccgacgccaaccccugcgacggcagcgcggccaaccuggugccggaggucaacaacgaggugauggcccucgagcccguggucggggccgccaucgcggcccccgugggcgggcagcagaacgugaucgaccccuggauccgcaacaacuucguccaggccccgggcggggaguucaccgugagcccccggaacgcccccggcgagauccugugguccgcgccccugggcccggaccucaaccccuaccugucccaccuggcccgcauguacaacggguacgccggcggguucgaggugcaggucauccucgccggcaacgccuucaccgcggggaaggugaucuucgccgccgugccgcccaacuuccccacggagggccugagccccucccaggucaccauguucccccacaucgugguggacguccggcagcuggagcccgugcucaucccgcugcccgacgugcgcaacaacuucuaccacuacaaccagagcaacgacuccaccaucaagcugaucgccaugcucuacacgccccugcgggccaacaacgcgggcgacgacgucuucaccgugagcugccgcgugcugacccggcccuccccggacuucgacuucaucuuccucgucccgcccaccguggagagccgcaccaagcccuucuccgugcccguccugacgguggaggagaugaccaacagccgguuccccacgccccuggagaagcuguucaccgggcccuccagcgccuucgucgugcagccgcagaacggccgcugcaccaccgacggggugcuccugggcaccacccagcucucccccgucaacaucugcacguuccggggcgacgugacccacaucaccgggagccgcaacuacaccaugaaccuggccucccagaacuggagcaacuacgaccccacggaggagaucccggcgccccugggcacccccgacuucguggggaagauccagggcguccucacccagaccacgcggaccgacgggagcacccgcggccacaaggccaccguguacaucggcuccgccgacuucgcccccaagcuggggcgggugcaguucgagacggacaccgaccacgacuucgagaccaaccagaacaccaaguucacgccggucggcgugauccaggacgggagcaccacccaccgcaacgagccccagcagugggugcugcccuccuacagcggccggaacacccccaacguccaccucgccccggccguggcccccacguuccccggggagcagcugcuguucuuccgcuccacccuccccggcugcagcggcuacccgaacauggaccuggacugccugcucccccaggagugggugcaguacuucuaccaggaggcggcccccgcccaguccgacgucgcccugcugcgguucgugaaccccgacaccgggcgcguccucuucgagugcaagcugcacaagagcggcuacgugaccguggcgcacaccgggcagcacgaccuggugaucccgcccaacggcuacuuccgguucgacuccugggucaaccaguucuacacgcucgcccccauggggaacggcaccggccgccgccgggcccuguga

SEQ ID NO: 9675 - RNA, 1623 nt, Artificial Sequence
  derived and/or modified sequence opt1 from VP1__Norovirus__AID60893
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccacgccccuggagaagcuguucaccggccccagcuccgccuucgucgugcagccgcagaacgggcgcugcaccaccgacggcgugcuccuggggaccacccagcucagccccgucaacaucugcacguuccggggcgacgugacccacaucaccggcucccgcaacuacaccaugaaccuggccagccagaacuggagcaacuacgaccccacggaggagaucccggcgccccuggggacccccgacuucgugggcaagauccaggggguccucacccagaccacgcggaccgacggcuccacccgcgggcacaaggccaccguguacaucggcagcgccgacuucgcccccaagcugggccgggugcaguucgagacggacaccgaccacgacuucgagaccaaccagaacaccaaguucacgccggucggggugauccaggacggcuccaccacccaccgcaacgagccccagcagugggugcugcccagcuacuccgggcggaacacccccaacguccaccucgccccggccguggcgcccacguuccccggcgagcagcugcuguucuuccgcagcacccuccccgggugcuccggcuacccgaacauggaccuggacugccugcucccccaggagugggugcaguacuucuaccaggaggccgcccccgcccagagcgacgucgcgcugcugcgguucgugaaccccgacaccggccgcguccucuucgagugcaagcugcacaaguccggguacgugaccguggcccacaccggccagcacgaccuggugaucccgcccaacggguacuuccgguucgacagcugggucaaccaguucuacacgcucgcccccaugggcaacgggaccggccgccgccgggcccuguga

SEQ ID NO: 9676 - RNA, 1623 nt, Artificial Sequence
  derived and/or modified sequence opt1 from VP1__Norovirus__AID68577
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggaugcucacccagaccacccggacggacggcagcacccgcgggcacaaggccaccgucuacaccggcuccgccgacuucgccccgaagcugggccgggugcaguucgagacggacaccgaccgcgacuucgaggccaaccagaacaccaaguucacccccgugggggucauccaggacggcagcacgacccaccggaacgagccccagcagugggugcugcccuccuacagcgggcgcaacaccccgaacgugcaccucgcccccgcggucgcccccaccuuccccggcgagcagcugcuguucuuccgguccacgaugccggggugcagcggcuaccccaacauggaccucgacugccugcugccccaggagugggugcaguacuucuaccaggaggccgcccccgcgcaguccgacguggcccuccugcgcuucgucaacccggacaccggccgggugcuguucgagugcaagcuccacaagagcggguacgugaccgucgcccacaccggccagcacgaccuggugaucccgcccaacggguacuuccgcuucgacuccugggugaaccaguucuacacccuggcccccaugggcaacgggacgggccgccggcgcgcccucuga

SEQ ID NO: 9677 - RNA, 1623 nt, Artificial Sequence
  derived and/or modified sequence opt1 from VP1__Norovirus__AID68578
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccacccgcacggacggcagcacccgggggcacaaggccaccguguacaccggcagcgccgacuucuccccgaagcugggccgcauccaguucgagacggacaccaaccacgacuucgaggccaaccagaacaccaaguucacccccgugggggucauccaggacggcgggacgacccaccggaacgagccccagcagugggugcugcccagcuacuccggccgcaacaccccgaacgugcaccucgcccccgccgucgcgcccaccuuccccggggagcagcugcuguucuuccggagcacgaugccgggcugcuccggcuaccccaacauggaccucgacugccugcugccccaggagugggugcaguacuucuaccaggaggccgcccccgcccagagcgacguggcgcuccugcgcuucgucaacccggacaccgggcgggugcuguucgagugcaagcuccacaaguccggcuacgugaccgucgcccacaccgggcagcacgaccuggugaucccgcccaacggcuacuuccgcuucgacagcugggugaaccaguucuacacccuggcccccauggggaacggcacgggccggcgccgcgcccucuga

SEQ ID NO: 9678 - RNA, 1623 nt, Artificial Sequence
  derived and/or modified sequence opt1 from VP1__Norovirus__AID68579
augaagauggccagcuccgacgccaaccccagcgacggcuccgcggccaaccuggugcccgaggucaacaacgaggugcucgcccuggagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccucggcccggaccugaaccccuaccugagccaccucgcccgcauguacaacggcuacgccgggggcuucgaggugcaggucauccuggccgggaacgccuucaccgccggcaaggugaucuucgccgccgugccgcccaacuucccgacggaggggcugucccccagccaggucaccauguucccccacaucgugguggacguccggcagcucgagcccgugcugaucccgcugcccgacgugcgcaacaacuucuaccacuacaaccaguccaacgaccccaccaucaagcucaucgccaugcuguacacgccccugcgggcgaacaacgccggcgacgacgucuucaccgugagcugccgcgugcucacccggccgucccccgacuucgacuucaucuuccuggucccgcccaccguggagagccgcaccaagcccuucuccgugcccguccugacgguggaggagaugaccaacagccgguuccccaucccccucgagaagcuguucaccggcccguccagcgccuucgucgugcagccccagaacgggcgcugcaccacggacggcgugcugcucgggaccacccagcugucccccgucaacaucugcaccuuccggggcgacgugacgcacaucaccggcagccacaacuacaccaugaaccuggccucccagaacuggaacaacuacgacccgaccgaggagauccccgcgccccucgggacgcccgacuucgugggcaagauccaggggguccugacccagaccacccgcacggacggcagcacccgggggcacaaggccaccguguacaccggcagcgccgacuucuccccgaagcugggccgcauccaguucgagacggacaccaaccacgacuucgaggccaaccagaacaccaaguucacccccgugggggucauccaggacggcgggacgacccaccggaacgagccccagcagugggugcuccccagcuacuccggccgcaacaccccgaacgugcaccuggcccccgccgucgcgcccaccuuccccggggagcagcuccuguucuuccggagcacgaugccgggcugcuccggcuaccccaacauggaccuggacugccugcucccccaggagugggugcaguacuucuaccaggaggccgcccccgcccagagcgacguggcgcugcugcgcuucgucaacccggacaccgggcggguccucuucgagugcaagcugcacaaguccggcuacgugaccguggcccacaccgggcagcacgaccuggugaucccgcccaacggcuacuuccgcuucgacagcugggugaaccaguucuacacccucgcccccauggggaacggcacgggccggcgccgcgcccuguga

SEQ ID NO: 9679 - RNA, 1623 nt, Artificial Sequence; identical to SEQ ID NO: 9501
  derived and/or modified sequence opt1 from VP1__Norovirus__AID68581

SEQ ID NO: 9680 - RNA, 1623 nt, Artificial Sequence
  derived and/or modified sequence opt1 from VP1__Norovirus__AID69174
augcgcauggccagcgacgacgccaaguccgcgcccagcgaccuggagggcgccgggcucgugccggccaccgccgcgccccugcccgucgcccccguggccggcgcccaggccgcggagccguucgccgggcagaucaacgugaucgaccccuggaucuacaccaacuucguccaggcccccacgggcgaguucaccgugagcccccggaacaccccgggggaggugcuggucaaccucgagaucggccccaaccugaaccccuaccugcagcaccucgcccagauguacaacggcuacgccgggggcguggaggugcaggucauccuggcggggaacgccuucaccgccggcaagcugcucugcgcccuggugcccccgggguuccccacguccuccaucacccccgcccagcugaccaugcucccccacaccaucaucgacgugcgcacgaccgacccggucguggugcccaugcccgacguccggcgcacccuguggcacgaggugcggagcaccacggagccccugaugcgccucgugaucaugcuguacaccccgaugcgggcgaacuccggcagcgacgaggccuucgucguguccggccgcgugcugagccggcccgcccccgacuucaacuucuucuaccucgugcccccgcgcguggaggacaccguggagcccuucucccugcccgaccugcgggucgacgagaugagcuccagccgcuggcagaaccccguggucaugcuccaggccgacccgaaccagaacaucgccgcgcacuggcagaacgggcggugcaccaucaacggcgagcugcuggggacgacgccccgcaaccaguccuggcuccugcggaugcgcggcagcgugcuggccgcccccggcgggcagaaggccgugaccgucaacguggaccucaccgagccggacggccaggccuucuccgugcugagcgggaaccccggccccgaggggguccccgacuuccaggcgaucuacaacgugcggauguccaccgccagcaccaccgccggccacaccguggccacgaacggcuacaucgagcagagcggguacaccccggcgcugggcacccucgucauccaggggguggaccugucccaggugcccgcccugggcagcgaggucaccaugcaggucguguccaucgaccucaaccacaacauggaccccacgcgccugcccgacuacaacggggccggcuucgacggcagcgucgcccuggccccgccccucgugccgccccugcccggggaggugcugcuccgguucaccacccugcccaucaccacgucccgcggcagcuccgucagcgcgacccuggacugcgcccuccccgccgaguggaucaccugguuccuggugcacaacuucgugccccagggggacgccgcccugcuccgguaccgcaaccgcggcaccgggcagauccuguucgagugcaagcuguacaaggagggcuuccucgcggucgccggcguguccacgcggaccguguucccgaccagcggggucuucgaguucguguccugggugcccgucuucuaccagcugacccccgugggcagcuccggggcccgcaagcggcagcgcuga

SEQ ID NO: 9681 - RNA, 1623 nt, Artificial Sequence
  derived and/or modified sequence opt1 from VP1__Norovirus__AIG59994
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaucggcagcgccgacuucgccccgaagcugggccgggugcaguucgagaccgacacggaccacgacuucgaggccaaccagaacaccaaguucacccccgucggggugauccaggacggcgggaccacgcaccgcaacgagccccagcagugggugcugcccuccuacagcggccggaacacccacaacguccaccucgccccggcgguggcccccaccuuccccggggagcagcugcuguucuuccgcuccaccaugcccggcugcagcggcuacccgaacauggaccucgacugccugcugccccaggagugggugcaguacuucuaccaggaggccgcccccgcgcaguccgacgucgcccuccugcgguucgugaaccccgacacggggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcaccggccgccgccgggccguguga

SEQ ID NO: 9682 - RNA, 1623 nt, Artificial Sequence
  derived and/or modified sequence opt1 from VP1__Norovirus__AIG59996
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccauccugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggaacaacuacgacccgaccgaggagauccccgcgccccuggggacgcccgacuucgugggcaagauccagggggugcucacccagaccacccggacggacggcagcacccgcgggcacaaggccaccgucuacaccggcagcgccgacuucgccccgaagcugggccgggugcaguucgagacggacaccgaccacgacuucgaggccaaccagaacaccaaguucacccccgugggggucauccaggacggcgggacgacccaccgcaacgagccccagcagugggugcugcccuccuacagcggccggaacacccacaacgugcaccucgccccggcggucgcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacguggcccuccugcgguucgucaaccccgacaccgggcgcgugcuguucgagugcaagcuccacaagagcggcuacgugaccgucgcccacaccgggcagcacgaccuggugaucccgcccaacggcuacuuccgguucgacuccugggugaaccaguucuacacccuggcccccauggggaacggcacgggccgccgccgggccgucuga

SEQ ID NO: 9683 - RNA, 1623 nt, Artificial Sequence; identical to SEQ ID NO: 9445
  derived and/or modified sequence opt1 from VP1__Norovirus__AIG59998

SEQ ID NO: 9684 - RNA, 1623 nt, Artificial Sequence
  derived and/or modified sequence opt1 from VP1__Norovirus__AIG60000
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggccacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgggccguguga

SEQ ID NO: 9685 - RNA, 1623 nt, Artificial Sequence
  derived and/or modified sequence opt1 from VP1__Norovirus__AIG60002
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgccgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcugcccuccuacagcgggcgcaacaccccgaacguccaccucgcgcccgccguggcccccaccuuccccggcgagcagcugcuguucuuccgguccaucaugccggggugcagcggcuaccccaacauggaccucgacugccugcugccccaggagugggugcaguacuucuaccaggaggccgcgcccgcccaguccgacgucgcccuccugcgcuucgugaacccggacacgggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggaccggccgccggcgcgcgcucuga

SEQ ID NO: 9686 - RNA, 1623 nt, Artificial Sequence; identical to SEQ ID NO: 9445
  derived and/or modified sequence opt1 from VP1__Norovirus__AIG60004

SEQ ID NO: 9687 - RNA, 1623 nt, Artificial Sequence; identical to SEQ ID NO: 9445
  derived and/or modified sequence opt1 from VP1__Norovirus__AIG60006

SEQ ID NO: 9688 - RNA, 1623 nt, Artificial Sequence
  derived and/or modified sequence opt1 from VP1__Norovirus__AIG60008
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgggcccucuga

SEQ ID NO: 9689 - RNA, 1623 nt, Artificial Sequence; identical to SEQ ID NO: 9499
  derived and/or modified sequence opt1 from VP1__Norovirus__AIG60010

SEQ ID NO: 9690 - RNA, 1623 nt, Artificial Sequence; identical to SEQ ID NO: 9445
  derived and/or modified sequence opt1 from VP1__Norovirus__AIG60012

SEQ ID NO: 9691 - RNA, 1623 nt, Artificial Sequence
  derived and/or modified sequence opt1 from VP1__Norovirus__AIG60014
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacacccacaacguccaccucgccccggcgguggcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgggccguguga

SEQ ID NO: 9692 - RNA, 1623 nt, Artificial Sequence; identical to SEQ ID NO: 9493
  derived and/or modified sequence opt1 from VP1__Norovirus__AIG60016

SEQ ID NO: 9693 - RNA, 1623 nt, Artificial Sequence; identical to SEQ ID NO: 9445
  derived and/or modified sequence opt1 from VP1__Norovirus__AIG60018

SEQ ID NO: 9694 - RNA, 1623 nt, Artificial Sequence
  derived and/or modified sequence opt1 from VP1__Norovirus__AIG60020
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggcaucgugcaguucgagacggacaccgaccacgacuucgaggccaaccagaacaccaaguucacccccgucggggugauccaggacggcagcacgacccaccggaacgagccccagcagugggugcugcccuccuacagcgggcgcaacaccccgaacguccaccucgcccccgcgguggcccccaccuuccccggcgagcagcugcuguucuuccgguccacgaugccggggugcagcggcuaccccaacauggaccucgacugccugcugccccaggagugggugcaguacuucuaccaggaggccgcccccgcgcaguccgacgucgcccuccugcgcuucgugaacccggacaccggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggacgggccggcgccgcgcccucuga

SEQ ID NO: 9695 - RNA, 1623 nt, Artificial Sequence; identical to SEQ ID NO: 9445
  derived and/or modified sequence opt1 from VP1__Norovirus__AIG60022

SEQ ID NO: 9696 - RNA, 1623 nt, Artificial Sequence; identical to SEQ ID NO: 9499
  derived and/or modified sequence opt1 from VP1__Norovirus__AIG60024

SEQ ID NO: 9697 - RNA, 1629 nt, Artificial Sequence
  derived and/or modified sequence opt1 from VP1__Norovirus__AII73717
augaagauggccagcaacgacgccgcgcccuccaacgacggcgccgccagccuggugccggaggggaucaacgagaccaugccccucgagcccgucgccggcgccuccaucgcggcccccguggccgggcagaccaacaucaucgacccguggauccgcacgaacuucgugcaggcccccaacggcgaguucaccgucagcccccggaacucccccggggagauccugcugaaccucgagcugggcccggaccugaaccccuaccucgcgcaccugagccgcauguacaacggcuacgccgggggcguggaggugcagguccugcucgccgggaacgccuucaccgccggcaagauccuguucgcggccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggguccggcgacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcccccaacgagaccaacgucgugcagugccagaacggccggugcacccucgacggggagcugcagggcacgacccagcugcucuccagcgcggugugcuccuaccgcgggcggaccgucgccaacaacggcgacaacugggaccagaaccugcugcagcucaccuaccccaacggcgccagcuacgacccgacggacgaggugcccgcgccccuggggacccaggacuucuccggcaugcuguacggggugcucacccaggacaacgucaacgugagcaccggcgaggccaagaacgccaaggggaucuacaucagcacgaccuccggcaaguucacccccaagaucggcagcaucgggcugcacuccaucaccgagcacguccacccgaaccagcagagccgcuucacgcccgugggcguggccgucaacgagaacacccccuuccagcagugggugcugccccacuacgccgggucccucgcccugaacaccaaccuggccccggcgguggcccccaccuuccccggcgagcagcuccuguucuuccggagccgcguccccugcgugcaggggcugcagggccaggacgccuucaucgacugccuccugccgcaggagugggugaaccacuucuaccaggaggccgcgcccucccaggccgacgucgcccugauccgguacgugaaccccgacacgggccgcacccucuucgaggccaagcugcaccggagcggguucaucaccgugucccacaccggcgccuacccccuggucgugccgcccaacgggcacuuccgcuucgacagcugggugaaccaguucuacucccucgcgcccaugggcacggggaacggccggcgccgcauccaguga

SEQ ID NO: 9698 - RNA, 1623 nt, Artificial Sequence
  derived and/or modified sequence opt1 from VP1__Norovirus__AII73720
augaagauggccagcaacgacgccacccccuccaacgacggcgcggccgggcuggugccggagagcaacaacgaggccauggcccucgagcccgucgugggcgccucccuggcggcccccgugaccgggcagacgaacaucaucgaccccuggauccgcaccaacuucguccaggccccgaacggcgaguucaccgugagcccccggaacucccccggggagauccuggugaaccucgagcugggccccgagcugaacccguaccucgcccaccuggcgcgcauguacaacggcuacgccgggggcauggagguccaggugaugcuggccgggaacgccuucaccgccggcaagaucaucuucgcggccgugccgcccuacuuccccgucgagaaccucagccccucccagaucacgauguucccccacgugaucguggacguccggacccuggagcccgugcugcuccccaugccggacgugcgcagcacccuguuccacuucaaccagaaggacgagcccaagaugcggcuggucgccaugcucuacacgccccugcgcuccaacgggagcggcgacgacguguucaccguguccugccggauccugacccgccccagcccggaguucgacuucaccuaccucgucccgcccaccguggaguccaagacgaagcccuucacccugcccgugcugacccucggcgagcugagcaacucccgguucccccugagcaucgacgagauggucaccucccccaacgagagcaucguggugcagccccagaacgggcgcgucacgcucgacggcgagcugcuggggaccacccagcuccaggccugcaacaucugcuccauccggggcaaggugaccggccaggucccgaacgagcagcacauguggaaccuggagaucacgaaccugaacgggacccaguucgaccccaccgacgacgugcccgccccgcucggcgugcccgacuucgcgggggaggucuucggcgugcugagccagcgcaaccgcggggagagcaaccccgccaaccgggcccacgacgccguggucgccaccuacuccgacaaguacacgcccaagcugggccucgugcagaucggcaccuggaacaccaacgacguggagaaccagccgaccaaguucacgcccaucgggcugaacgaggucgcgaacggccaccgguucgagcaguggacccugccccgcuacagcggggcccucacccugaacaugaaccuggcccccgccguggccccgcuguuccccggcgagcggcuccuguucuuccgcuccuacgugccccucaagggcggguucggcaaccccgcgaucgacugccuggucccgcaggagugggugcagcacuucuaccaggagagcgcccccucccugggggacguggcccucguccgguacgugaaccccgacaccggccgcgugcuguucgaggccaagcugcacaagggcggguuccucacggucagcuccaccagcaccgggcccgugguggucccggcgaacggcuacuuccgguucgacuccugggugaaccaguucuacagccuggcccccaugggcaccgggaacggccgccgccgguuccaguga

SEQ ID NO: 9699 - RNA, 1611 nt, Artificial Sequence
  derived and/or modified sequence opt1 from VP1__Norovirus__AII73723
augaagauggccagcaacgacgccacccccuccgacgacggcgcggccgggcuggugccggagaucaacagcgaggucauggcccucgagcccguggccggcgccuccaucgcggcccccguggucgggcagcagaacaucaucgaccccuggauccgcaacaacuucgugcaggccccggccggcgaguucaccgugagcccccggaacucccccggggagcugcugcucgaccuggagcugggccccgagcucaacccguaccuggcgcaccuggcccgcauguacaacggccacgccgggggcauggagguccagaucgugcucgccgggaacgccuucacggcgggcaagauccuguucgccgccaucccgcccagcuuccccuacgagaaccugucccccgcccagcucaccaugugcccccacgugaucgucgacgugcggcagcuggagcccgugcugcuccccaugccggacauccgcaacgucuucuaccacuacaaccagaacaacagccccaagcugcggcugguggccaugcucuacacgccccugcgcgcgaacaacuccggggacgacguguucaccgucagcugccgggugcugacccgccccuccccggacuuccaguucaccuuccucgugccgcccaccgucgagagcaagaccaagaacuucacgcugcccgugcugcggguguccgagaugaccaacagccgcuuccccgucgugcucgaccagauguacaccucccggaacgagaacaucaucgugcagccccagaacggccgcugcaccacggacggcgagcugcuggggaccaccauccuccagagcgucuccaucugcaacuucaagggcaccaugcaggccaagcugaacgaggagccccgguaccagcugcagcucacgaaccuggacgggagccccaucgacccgaccgacgacaugcccgcgccccugggcaccccggacuuccaggccgugcucuacggcgucgccucccagcgcagcagccgggacaacgccacccgcgcccacgacgcccagaucgacacggccggggacaccuucgcccccaagaucggccaggugcgguucaaguccagcuccaacgacuucgaccugcacgaccccaccaaguucacccccaucggggugaacgucgacgaccagcacccguuccgccaguggagccugcccaacuacggcgggcaccucgcgcugaacaaccaccuggcccccgccgugacgccccucuucccgggcgagcagauccuguucuuccgguccuacauccccagcgccggcgggcacaccgacggcgcgauggacugccugcucccccaggaguggguggagcacuucuaccaggaggccgcccccucccagagcgacaucgcccugguccgcuucaucaacccggacaccgggcgggugcuguucgaggccaagcuccacaagcagggcuuccugaccaucgcggccuccggggaccaccccaucgugaugcccacgaacggcuacuuccgcuucgaggccugggucaaccccuucuacacccuggccccggugggcaccgggagcggccgccggcgcauccaguga

SEQ ID NO: 9700 - RNA, 1623 nt, Artificial Sequence; identical to SEQ ID NO: 9445
  derived and/or modified sequence opt1 from VP1__Norovirus__AII73726

SEQ ID NO: 9701 - RNA, 1623 nt, Artificial Sequence; identical to SEQ ID NO: 9445
  derived and/or modified sequence opt1 from VP1__Norovirus__AII73729

SEQ ID NO: 9702 - RNA, 1623 nt, Artificial Sequence; identical to SEQ ID NO: 9445
  derived and/or modified sequence opt1 from VP1__Norovirus__AII73732

SEQ ID NO: 9703 - RNA, 1608 nt, Artificial Sequence
  derived and/or modified sequence opt1 from VP1__Norovirus__AII73735
augaagauggccagcuccgacgccgcgcccagcaacgacggcgccgccgggcuggugccggaggccaacaacgagaccauggcccucgagcccgucgcgggcgccuccaucgccgcgccccugaccgggcagaacaacaucaucgaccccuggauccgccugaacuucgugcaggccccgaacggcgaguucacggugagcccccggaacucccccggggagguccuccugaaccuggagcucggccccgagcugaacccguaccuggcccaccucagccgcauguacaacggcuacgccgggggcguggaggugcagguccugcuggccgggaacgccuucaccgcgggcaagcucguguucgccgccgugccgccccacuucccccuggagaacaucucccccgggcagaucaccauguucccccacgucaucaucgacgugcggacccuggagcccgugcuccugccccugccggacguccgcaacaacuucuuccacuacaaccagcagaacgagccccggaugcgccucguggccaugcuguacacgccccugcggagcaacggcuccggcgacgacguguucaccgucagcugccgcgugcucacccggcccuccccggacuucgacuucaacuaccuggugccgcccaccgucgagagcaagacgaagcccuucacccugcccauccucaccaucggggagcugaccaacucccgcuuccccgugcccaucgacgagcuguacacgagccccaacgagucccucgugguccagccgcagaacggccggugcgcccuggacggggagcugcagggcaccacccagcuccugcccaccgcgaucugcagcuuccgcggccggaucaaccagaagguguccggggagaaccacguguggaacaugcaggucacgaacaucaacggcacccccuucgacccgaccgaggacgugcccgcgccccuggggacccccgacuucagcggcaagcuguucgggguccucuccccgcgcgaccacgacaacgccugccggagccacgacgccgugaucgccacgaacagcgccaaguucacccccaagcugggcgccauccagaucggcaccugggaggagaacgacgugcacaucaaccagcccaccaaguucacgcccgucggccucuucgaggacgagggguucaaccaguggacccugccgaacuacuccggggcccugacccucaacaugggccuggccccgcccguggcccccaccuuccccggggagcagauccuguucuuccgcagccacaucccccucaagggcggcguggcggaccccgucaucgacugccugcugccccaggaguggauccagcaccucuaccaggaguccgccccgagccaguccgacguggcccugauccgguucacgaaccccgacaccgggcgcgugcuguucgaggccaagcuccaccggagcggcuacaucaccgucgcgaacaccgggucccgccccaucguggugcccgccaacggcuacuuccgguucgacagcugggucaaccaguucuacucccuggccccgauggggacgggcaacggccgccgccgggugcaguga

SEQ ID NO: 9704 - RNA, 1623 nt, Artificial Sequence; identical to SEQ ID NO: 9499
  derived and/or modified sequence opt1 from VP1__Norovirus__AII73738

SEQ ID NO: 9705 - RNA, 1620 nt, Artificial Sequence
  derived and/or modified sequence opt1 from VP1__Norovirus__AII73741
augaagauggccagcaacgacgccgcgcccuccaacgacggcgccaccgggcuggugccggagaucaacaccgagacgcucccccuggagcccgucgccggcgccgccaucgcggcccccgugaccgggcagaacaacaucaucgacccguggauccgcaacaacuucgugcaggcccccaacggcgaguucaccgucagcccccggaacucccccggggagauccugaugaaccucgagcugggcccggaccugaaccccuaccucgcccaccugagccgcauguacaacggcuacgccgggggcguggaggugcagguccugcucgccgggaacgccuucaccgccggcaagauccuguucgccgcggugccgcccaacuuccccguggacaugcugucccccgcccagaucacgaugcucccccaccugaucgucgacgugcggacccuggagcccaucaugaucccgcuccccgacgugcgcaacgucuucuaccacuucaacaaccagcccgcgccccggaugcgccugguggccaugcuguacaccccgcuccggagcaacggguccggcgacgacguguucaccgucagcugccgcgugcugacgcggcccacccccgacuucgaguucaccuaccuggugcccccguccgucgagagcaagaccaagcccuucacgcuccccauccugaccaucggcgagcugaccaacucccgcuuccccgccccgaucgaccagcucuacaccagccccaacgcggacaucguggugcagccccagaacgggcggugcacgcuggacggcgagcugcaggggaccacccagcuccugaccacggccaucugcuccuaccgcggcaugaccagcaacccgaccuccgacuacugggacgaccaccuccugcaccugguccaccccaacggcgccaccuacgaccccacggaggacgugcccgccccguucgggacccaggacuuccggggcauccuguacgggaugcucacccagaacccccgcaccagcggcgacgaggccgcgaacucccacgggaucuacaucagcuccacgagcgagaaguucacccccaagcugggcaccaucggccugcaccaggugcagggggacaucgccagcaaccagcaguccaaguucacccccgucggcaucgccgugaacgggaacacgccguuccggcagugggagcuccccaacuacagcggcgcccugacccugaacaccaaccucgcccccgcggucgggcccaacuucccgggcgagcagauccuguucuuccgcuccaacgugcccagcgugcagggcgggcagcccaucgagaucgacugccugaucccccaggagugggucucccacuucuaccaggagagcgccccgucccagagcgacguggcccucgugcgguacgucaaccccgacaccggccgcacgaucuucgaggccaagcugcaccggcagggguucaucaccaucgcggccaccggcuccaaccccgugguggugcccccgaacggguacuuccgcuucgacagcugggucaaccaguucuacgcccuggcccccaugggcaccggcaacgggcggcgccgcgugcaguga

SEQ ID NO: 9706 - RNA, 1623 nt, Artificial Sequence; identical to SEQ ID NO: 8842
  derived and/or modified sequence opt1 from VP1__Norovirus__AII73744

SEQ ID NO: 9707 - RNA, 1623 nt, Artificial Sequence
  derived and/or modified sequence opt1 from VP1__Norovirus__AII73747
augaagauggccagcaacgacgccgcgcccuccaacgacggcgccaccgggcuggugccggagaucaacaacgagacccucccccuggagcccgucgccggcgccgccaucgcggcccccgugacggggcagaacaacaucaucgacccguggauccgcaccaacuucgugcaggcccccaacggcgaguucaccgucagcccccggaacucccccggggagauccugcucaaccuggagcugggcccggaccucaaccccuaccuggcccaccugagccgcauguacaacggcuacgccgggggcguggaggugcagguccuccuggccgggaacgccuucaccgccggcaagauccuguucgccgcggugccgcccaacuuccccguggaguuccucucccccgcccagaucacgaugcugccccaccugaucgucgacgugcggacccucgagcccaucaugaucccgcugcccgacgugcgcaacaccuucuuccacuacaacaaccagcccgccaaccggaugcgccuggucgccaugcucuacacgccccugcggagcaacggguccggcgacgacguguucaccgugagcugccgcguccugacccggccgacccccgacuucgaguucaccuaccucgugccgcccuccguggagagcaagacgaagcccuucucccugcccauccugaccaucagcgagcucaccaacucccgcuuccccgcccccaucgacagccuguucaccgcgcagaacaacaaccugaacguccagugccagaacggccggugcacgcucgacggggagcugcagggcaccacccagcugcucccguccgggaucugcgccuuccgcggccggcugaccgccgacguggacggcagccacgacgaccgcuggcacaugcagcugacgaaccucaacgggacccccuucgaccccaccgaggacgugccggcgccccugggcacccccgacuucacggggcuccuguucggcgucgccucccagcggaacguggggagcaaccccaacaccacccgcgcgcacgaggccgugaucuccaccacgagcagccaguucgucccgaagcugggcuccgugaacuucggcagcaccuccaccgacuuccagcugcagcagcccaccaaguucacgcccgucgggaucaagaucgagagcggccacgaguucgaccagugggcccucccccgguacuccgggcaccugacccugaacaugaaccucgccccgcccaucgcccccaacuuccccggcgagcagcugcuguucuuccgcagcaacgugccgugcgccgggggcguguccgacggcgucaucgacugccuccugccccaggaguggauccagcacuucuaccaggagagcgcgcccucccagagcgacguggcccugauccgguacgugaaccccgacaccgggcgcacccucuucgaggccaagcugcaccggacgggcuacaucaccgucgcgcacuccggggacuacccgcugguggugcccagcaacggcuacuuccgcuucgacuccugggucaaccaguucuacagccuggcccccauggggaccggcaacggccgccggcgcgugcaguga

SEQ ID NO: 9708 - RNA, 1623 nt, Artificial Sequence
  derived and/or modified sequence opt1 from VP1__Norovirus__AII73750
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggccacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgaggacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcugcuggggaccacgcagcucucccccgucaacaucugcaccuuccggggcgacgugacccacaucgccggcagccgcaacuacaccaugaaccuggccucccugaacuggaacaacuacgaccccacggaggagaucccggcgccccucgggacccccgacuucgugggcaagauccaggggguccugacccagaccacgaagggcgacgggagcacccggggccacaaggccaccguguacaccggcagcgcccccuucacgccgaagcugggguccgugcaguucagcaccgacaccgagaacgacuucgagacccaccagaacacgaaguucacccccgucggcgugauccaggacgggggcaccacccaccgcaacgagccccagcagugggugcuccccuccuacagcgggcggaacguccacaacgugcaccuggccccggccguggcccccacguuccccggcgagcagcuccucuucuuccgcuccaccaugcccggcugcagcggguacccgaacauggaccuggacugccugcucccccaggaguggguccagcacuucuaccaggaggcggcccccgcccaguccgacguggcccugcugcgguucgugaaccccgacaccggccgcguccucuucgagugcaagcugcacaagagcggguacgugaccguggcgcacaccggccagcacgaccuggucaucccgcccaacggguacuuccgguucgacuccugggugaaccaguucuacacgcucgcccccaugggcaacggcaccgggcgccggcgcgcccuguga

SEQ ID NO: 9709 - RNA, 1623 nt, Artificial Sequence
  derived and/or modified sequence opt1 from VP1__Norovirus__AII73753
augaagauggccagcaacgacgccacccccuccaacgacggcgcggccgggcuggugccggagagcaacaacgaggccauggcccucgagcccgucgugggcgccucccuggcggcccccgugaccgggcagacgaacaucaucgaccccuggauccgcaccaacuucguccaggccccgaacggcgaguucaccgugagcccccggaacucccccggggagauccuggugaaccucgagcugggccccgagcugaacccguaccucgcccaccuggcgcgcauguacaacggcuacgccgggggcauggagguccaggugaugcuggccgggaacgccuucaccgccggcaagaucaucuucgcggccgugccgcccuacuuccccgucgagaaccucagccccucccagaucacgauguucccccacgugaucaucgacgugcggacccuggagcccguccugcuccccaugccggacgugcgcagcacccuguuccacuucaaccagaaggacgagcccaagaugcggcugguggccaugcucuacacgccccugcgcuccaacgggagcggcgacgacgucuucaccguguccugccggauccugacccgccccagcccggaguucgacuucaccuaccucgugccgcccaccgucgaguccaagacgaagcccuucacccugcccgugcugacccucggcgagcugagcaacucccgguucccccugagcaucgacgagauggugaccucccccaacgagagcaucgucgugcagccccagaacgggcgcgugacgcucgacggcgagcugcuggggaccacccagcuccaggccugcaacaucugcuccauccggggcaaggucaccggccaggugccgaacgagcagcacauguggaaccugcagaucacgaaccugaacgggacccaguucgaccccaccgacgacguccccgccccgcucggcgugcccgacuucgcgggggagguguucggcguccugagccagcgcaaccgcggggagagcaaccccgccaaccgggcccacgacgccgugguggccaccuacuccgacaaguacacgcccaagcugggccucguccagaucggcaccuggaacaccaacgacguggagaaccagccgaccaaguucacgcccaucgggcugaacgagguggcgaacggccaccgguucgagcaguggacccugccccgcuacagcggggcccucacccugaacaugaaccuggcccccgccgucgccccgcuguuccccggcgagcggcuccuguucuuccgcuccuacgugccccucaagggcggguucggcaaccccgcgaucgacugccuggugccgcaggaguggguccagcacuucuaccaggagagcgcccccucccugggggacguggcccucgugcgguacgucaaccccgacaccggccgcgugcuguucgaggccaagcugcacaagggcggguuccucacggugagcuccaccagcaccgggcccgucguggugccggcgaacggcuacuuccgguucgacuccugggucaaccaguucuacagccuggcccccaugggcaccgggaacggccgccgccgguuccaguga

SEQ ID NO: 9710 - RNA, 1623 nt, Artificial Sequence; identical to SEQ ID NO: 8842
  derived and/or modified sequence opt1 from VP1__Norovirus__AII73756

SEQ ID NO: 9711 - RNA, 1668 nt, Artificial Sequence
  derived and/or modified sequence opt1 from VP1__Norovirus__AII73759
augcgcauggccagcuccgacgcccccgugagcggcaccgacggggcggccggccuggucccggagucccagcaggaggugcucccccuggagcccguggccgggguccagcuggccgcccccguggcgggccagagcaacaucaucgacccguggauccggaugaacuucgugcaggcccccgccggggaguucaccgucagcccccgcaacgcccccggcgaggugcucaucgaccuggagcugggcccggagcucaaccccuaccugaaccaccuggcgcggauguacaacggguacgugggcgggauggaggucgagguggugcucgccggcaacgccuucacggccgggaagauccuguucgccgcggucccgcccuccuuccccacccacggcaucuccgccgcccaggccaccaugcugccccacgugaucguggacguccgccagcucgagcccgugcggcugccccugccggacgugcgcaacgucauguuccacuucugccaggagaacaaggagccccggaugcgcaucguggccauccucuacacgccccugcgggcgaacggcgccggggacgacguguucaccgucagcugccgcgugcugacccggcccuccccggacuucgacuucaucuuccucgugccgcccagcgucgaguccaagcugaagcaguucacccugcccaaccuccagcccaacgagaugaccaacagccgcuuccccacgggcaucacccagcuguacaccucccccaacaccaaccuggugguccaguuccagaacgggcggugccuccuggacggcacgcugcucggcaccacccccgugcgcgccgccgacaucugcagcuuccgcggggugaccuccacggaggucgacgccaccgacagcccgcggguggcgggcucccaccggaucauggugcagcugcgcgagcccgacggggaggaguucagccccaccggcccgaaccccgcccccgucgggacccccgacuuccaggccgccaucuucggcacgcugucccagcggaacaccggcggggccggccagaacagcaaccgcgcgcacuucgccuacuucuacacccggaacccgaccuucgcccccgggaucggcacggugguguucagcuucgacaccaccgacuuccagaaccgccagcccaccaaguucucccccagcggggucuucgacgacgacuccagcgagccguucaaccaguucucccuccccuacuacaacggcagccugggcgccguggacgcggggaagcuggccccgcccguggcccccaacuaccccggcgagcagauccucuacuuccgcggguccguccccuucaagggcggguacggcgagggcgagaucgacagccugcugccccaggaguggaucacgcacuucuacgccgagcaggccccgacccagggggacgcggcccuccugcgguacuacaaccccgacaccggccgcgugcuguucgagugcaagcuccaccgggagggguucaucaccaucaacuacacgggcuccaacgcccuggccgugcccgucaacggcguguuccgcuucgaggggugggugaacaaguucuacacccugacccccaugggcaacgggaacggccggcgcgggcggcgccgggagcucuga

SEQ ID NO: 9712 - RNA, 1668 nt, Artificial Sequence
  derived and/or modified sequence opt1 from VP1__Norovirus__AII73762
augaagauggccagcaaggacgccucccccagcaccgacggcaccgcgaaccuggugccggagucccagcaggagguccucgcccugcagcccguggccggggcccagaucgccgcgcccguggccggccaguucaacgucaucgaccccuggaucuaccagaacuucgugcaggccccggagggggaguucacggugagcccccgcaacuccaccggcgagauccugaugaaccucgagcuggggccccagcugaaccccuaccucgcccaccuggcgcggauguacaacgccuacgccggcggcuucgagguccaggugcugcucgccgggaacgccuucaccgcgggcaagaucaucgugugcgccgucccgcccaacuucccccugcagaacaucagcgccgcccaggccacccagcugccccacgugguggucgacgugcgccagcucgagccggugguccugccccugcccgacgugcgggcgggguucuaccacuacaaccagguggaggagucccgcaugcggcucgucgccauccuguacacgccccugcgcaccaacagcgccggcgacgacgccuucaccguguccugccggauccucacccgcccggcccccgacuucagcuucuucuuccugaucccgcccacgaucgaguccaagaccacccccuucacccugccccggcuccccaucagcgagaugacgaacucccgcuucccccuggugaucaaggggauggucguggacccgaaccugccccuccaggcgaacuuccagaacggccggaucacccuggacggcgagcugcaggggaccacccuccccacgagcaccuccaucggccgcaucagcgggacccacauguccagcacccccucccggaucauccagcacgaggacagcggcgacagcacgcagccgcgcguguucaaccccgucuggauggaccugaccgagaacaacuggaccgaguuccagcccuucaacgaccagccggcgccccugggcugccccgacuucaaggccaagauccucgggacccugauccggcagcccaacaacggcuccuacuacuucgacgccuaccuggacacgcgccagcacgggaccuucgccccguacaccggccacgccgccgugcacagcgaccagcaggccgggcaccucgcccagggcuacaagauccaguucucccccaccggcaucgagagcgaccagaacacggaccugaaccagcugcccgacuacgggggcgcgaugaccgucuccaaggggcucgcccccgccgccgccccggacuuccccggcgagaugauccuguacuucgugagcgacaugcccgugcggaaccccaacggggagcgccgggacaccgagauccugugccuccugccgcaggagauggucacccacuucuacgagcagcaggcgcccucccagggcgacguggcccuggugcgcuacaucaacgccgagacgggccgggucauguucgaggggaagcuccaccgcaacggcuucuucaccgugagcgccaccgcccgcacccugaucgugcccgacggguacuuccgguucgacuccugggucaaccgcuucuacacgcugagccccaugggcaccgggaacggccggcgccgggcgcgcaugcucgaguga

SEQ ID NO: 9713 - RNA, 1638 nt, Artificial Sequence
  derived and/or modified sequence opt1 from VP1__Norovirus__AII73765
augaugauggccagcaaggacgcccccaccaacauggacggcaccuccggggcgggccagcuggugccggaggccaacacggccgagcccaucagcauggagcccgucgccggggccgcgaccgccgccgccaccgcgggccaggugaacaugaucgaccccuggaucaugaacaacuacgugcaggccccgcagggggaguucaccaucucccccaacaacacgcccggcgacauccucuucgaccugcagcugggcccccaccucaacccguuccugagccaccuggcccagauguacaacgggugggucggcaacaugaaggugaaggugcuccuggccgggaacgccuucaccgcgggcaagaucaucaucuccugcaucccgcccggguucgucgcccagaacgugagcaucgcccaggccaccauguucccccacgugaucgccgacguccgcgugcuggagcccaucgaggugccccucgaggacguccggaacgugcuguuccacaacaacgacaacacccccacgaugcgccuggugugcaugcucuacacgccccugcgggcguccggcagcuccagcggcaccgacccguucgucaucgccgggcgcgugcugaccugccccucccccgacuucagcuuccucuuccuggugcccccgaacgucgagcagaagaccaagcccuucuccgugcccaaccugccccucaacacccugagcaacucccgggugccgagccugaucaaguccaugauggucagccgcgaccacggccagauggugcaguuccagaacgggcgggugacccucgacggccagcugcagggcaccacgcccaccuccgccagccagcugugcaagauccgcgggagcgucuuccacgccaacggcgggaacggcuacaaccucaccgagcuggacgggucccccuaccacgccuucgagagccccgcgccgaucggcuuccccgaccugggcgagugcgacuggcacauggaggccucccccaccacgcaguucaacaccggggacgugaucaagcagaucaacgucaagcaggagagcgccuucgccccgcaccucggcaccauccaggccgacgggcuguccgacgugagcgugaacaccaacaugaucgcgaagcugggcugggucucccccgugagcgacgggcacaagggcgacguggaccccugggucaucccccgguacggcuccacgcucaccgaggccgcccagcuggccccgcccaucuacccgcccggguucggcgaggcgaucguguucuucaugagcgacuuccccaucgcccacgggaccaacggccuguccgugcccugcaccaucccccaggaguucgucacgcacuucgugaacgagcaggcccccacccgcggggaggccgcccuccugcacuaccuggacccggacacccaccggaaccucggcgaguucaagcuguaccccgacggcuucaugaccugcgugcccaacagcuccgggacgggcccccagacccugccgaucaacggggucuucguguucgugagcugggucucccgcuucuaccagcucaagcccgugggcaccgcgggccccgcccggcgccuggggauccggcgcagcuga

SEQ ID NO: 9714 - RNA, 1623 nt, Artificial Sequence; identical to SEQ ID NO: 9445
  derived and/or modified sequence opt1 from VP1__Norovirus__AII73768

SEQ ID NO: 9715 - RNA, 1608 nt, Artificial Sequence
  derived and/or modified sequence opt1 from VP1__Norovirus__AII73771
augaagauggccagcuccgacgccgcgcccagcaacgacggcgccgccgggcuggugccggaggccaacaacgagaccauggcccucgagcccgucgcgggcgccuccaucgccgcgccccugaccgggcagaacaacaucaucgaccccuggauccgccugaacuucgugcaggccccgaacggcgaguucacggugagcccccggaacucccccggggagguccuccugaaccuggagcucggccccgagcugaacccguaccuggcccaccucagccgcauguacaacggcuacgccgggggcguggaggugcagguccugcuggccgggaacgccuucaccgcgggcauccucguguucgccgccgugccgccccacuucccccuggagaacaucucccccgggcagaucaccauguucccccacgucaucaucgacgugcggacccuggagcccgugcuccugccccugccggacguccgcaacaacuucuuccacuacaaccagcagaacgagccccggaugcgccucguggccaugcuguacacgccccugcggagcaacggcuccggcgacgacguguucaccgucagcugccgcgugcucacccggcccuccccggacuucgacuucaacuaccuggugccgcccaccgucgagagcaagacgaagcccuucacccugcccauccucaccaucggggagcugaccaacucccgcuuccccgugcccaucgacgagcuguacacgagccccaacgagucccucgugguccagccgcagaacggccggugcgcccuggacggggagcugcagggcaccacccagcuccugcccaccgcgaucugcagcuuccgcggccggaucaaccagaagguguccggggagaaccacguguggaacaugcaggucacgaacaucaacggcacccccuucgacccgaccgaggacgugcccgcgccccuggggacccccgacuucagcggcaagcuguucgggguccucucccagcgcgaccacgacaacgccugccggagccacgacgccgugaucgccacgaacagcgccaaguucaccccgaagcugggcgccauccagaucggcaccugggagcaggacgacgugcacaucaaccagcccaccaaguucacgcccgucggccucuucgagaacgagggguucaaccaguggacccugcccaacuacuccggggcccugacccucaacaugggccuggccccgcccguggcccccaccuuccccggggagcagauccuguucuuccgcagccacaucccgcucaagggcggcguggcggaccccgucaucgacugccugcugccccaggaguggauccagcaccucuaccaggaguccgcccccagccaguccgacguggcccugauccgguucacgaacccggacaccgggcgcgugcuguucgaggccaagcuccaccggagcggcuacaucaccgucgcgaacaccgggucccgccccaucguggugcccgccaacggcuacuuccgguucgacagcugggucaaccaguucuacucccuggcccccauggggacgggcaacggccgccgccgggugcaguga

SEQ ID NO: 9716 - RNA, 1623 nt, Artificial Sequence
  derived and/or modified sequence opt1 from VP1__Norovirus__AII73774
augaagauggccagcaacgacgccgcgcccuccaacgacggcgccgccgggcuggugccggagaucaacaacgaggucaugccccucgagcccguggccggcgccagccuggcgacccccguggucgggcagcagaacaucaucgacccguggauccgcaacaacuucgugcaggcccccgccggcgaguucaccgugagcccccggaacucccccggggagauccugcucgaccuggagcugggcccggagcucaaccccuaccuggcccaccuggcgcgcauguacaacggccacgccgggggcauggagguccagaucgugcucgccgggaacgccuucacggccggcaagaucaucuucgcggccaucccgcccggguuccccuacgagaaccugucccccagccagaucaccaugugcccccacgugaucaucgacguccggcagcuggagcccgugcuccugccgaugcccgacauccgcaacaacuucuuccacuacaaccagggcaacgaccccaagcugcggcucaucgccaugcuguacacgccccugcgcgccaacaacuccggcgacgacguguucaccgucagcugccgggugcucaccaagccgucccccgacuucgaguucaccuuccuggugccgcccaccgucgagagcaagaccaagcaguucacgcugcccauccucaagaucuccgagaugaccaacagccgcuuccccgugcccguggagaugauguacaccgcccggaacgagaaccaggucgugcagccccagaacgggcgcgugacccuggacggcgagcugcucgggacgaccccgcugcuggcggucaacaucugcaaguucaagggcgaggugaucgccaagaacggcgacgugcgguccuaccgcauggacauggagaucaccaacaccgacgggacgcccaucgaccccaccgaggacaccccgggccccaucgggagccccgacuuccagggcauccucuucggggucgccucccagcggaacaagaacgagcagaaccccgccacccgcgcccacgaggcgaacaucaacacgggcggcgaccaguacgccccgaagcuggcccaggugaaguucuucagcgagucccaggacuucgagguccaccagcccaccguguucacccccgugggggucgccggcgacaccagccaccccuuccggcagugggugcugccgcgcuacgggggccaccucacgaacaacacccaccuggcccccgcgguggcgccccuguuccccggggagcagauccucuucuuccggucccagaucccgagcagcggcggccacgagcugggguacauggacugccuggucccccaggagugggugcagcacuucuaccaggaggccgccaccgcccaguccgagguggcccucauccgcuucaucaaccccgacaccggccggguccuguucgaggccaagcugcacaagcagggguucaucacgguggcccacaccggcgacaaccccaucgugaugccgcccaacggguacuuccgcuucgaggccugggucaaccaguucuacagccucgcgcccgugggcaccggcaacgggcggcgccgcauccaguga

SEQ ID NO: 9717 - RNA, 1623 nt, Artificial Sequence
  derived and/or modified sequence opt1 from VP1__Norovirus__AII73777
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcaguacgaccuggugaucccgcccaacggcuacuuccgguucgacuccugggucaaccaguucuacacccuggcccccauggggaacggcacgggccgccgccgggccguguga

SEQ ID NO: 9718 - RNA, 1611 nt, Artificial Sequence
  derived and/or modified sequence opt1 from VP1__Norovirus__AII73780
augaagauggccagcaacgacgccacccccuccgacgacggcgcggccgggcuggugccggagaucaacagcgaggucauggcccucgagcccguggccggcgccuccaucgcggcccccguggucgggcagcagaacaucaucgaccccuggauccgcaacaacuucgugcaggccccggccggcgaguucaccgugagcccccggaacucccccggggagcugcugcucgaccuggagcugggccccgagcucaacccguaccuggcgcaccuggcccgcauguacaacggccacgccgggggcauggagguccagaucgugcucgccgggaacgccuucacggcgggcaagauccuguucgccgccaucccgcccagcuuccccuacgagaaccugucccccgcccagcucaccaugugcccccacgugaucgucgacgugcggcagcuggagcccgugcugcuccccaugccggacauccgcaacgucuucuaccacuacaaccagaacaacagccccaagcugcggcugguggccaugcucuacacgccccugcgcgcgaacaacuccggggacgacguguucaccgucagcugccgggugcugacccgccccuccccggacuuccaguucaccuuccucgugccgcccaccgucgagagcaagaccaagaacuucacgcugcccgugcugcggguguccgagaugaccaacagccgcuuccccgucgugcucgaccagauguacaccucccggaacgagaacaccaucgugcagccccagaacggccgcugcacgaccgacggcgagcugcuggggaccaccauccuccagagcgucuccaucugcaacuucaagggcacgaugcaggccaagcugaacgaggagccccgguaccagcugcagcucaccaaccuggacgggagccccaucgacccgaccgacgacaugcccgcgccccugggcaccccggacuuccaggccgugcucuacggcgucgccucccagcgcagcagccgggacaacgccacgcgcgcccacgacgcccagaucgacaccgccggggacaccuucgcccccaagaucggccaggugcgguucaaguccagcuccaacgacuucgaccugcacgaccccaccaaguucacgcccaucggggugaacgucgacgaccagcacccguuccgccaguggagccugcccaacuacggcgggcaccucgcgcugaacaaccaccuggcccccgccgugacgccccucuucccgggcgagcagauccuguucuuccgguccuacauccccagcgccggcgggcacaccgacggcgcgauggacugccugcucccccaggaguggguggagcacuucuaccaggaggccgcccccucccagagcgacaucgcccugguccgcuucaucaacccggacaccgggcgggugcuguucgaggccaagcuccacaagcagggcuuccugaccaucgcggccuccggggaccaccccaucgugaugcccaccaacggcuacuuccgcuucgaggccugggucaaccccuucuacacccuggccccggugggcaccgggagcggccgccggcgcauccaguga

SEQ ID NO: 9719 - RNA, 1632 nt, Artificial Sequence
  derived and/or modified sequence opt1 from VP1__Norovirus__AII73783
augaugauggccagcaaggacgcccccaccaacauggacggcaccuccggggcgggccagcuggugccggaggccaacacggccgagccccuccccaucaagcccgucgccggggccgcgaccgccguggccaccgccggccaggugaacaugaucgacccguggaucaugaacaacuucguccaggcgccccagggggaguucaccaucagccccaacaacacgcccggcgacauccuguucgaccugcagcucggcccgcaccugaaccccuuccuggcccaccucucccgcauguacaacgggugggugggcaacaugcagguccggaucaugcuggccgggaacgccuucagcgccggcaagaucaucgugugcugcaucccgcccggguucuccagccaguccaucagcaucgcgcaggccaccauguucccccacgugaucgccgacgugcgcguccuggagcccaucgacgugccccucgacgacgugcggaacguccuguuccacaacaacgacaacccccagaccaugcgccugcucugcaugcuguacaccccgcugcgguccggcggcacgagcuccgggaccgaccccuucgugaucgccggccgcgugcugaccugccccacccccgacuucagcuuccucuuccuggucccgcccgacaucgagcagcggacgaagcccuucuccgugcccaacaucccgaugaaccucaugagcaacucccgcgugagcaugcugaucgacgggaugauggucuccaacgaccagaaccaggugccccaguuccagaacggccgggugacccuggacggccagcuccaggggaccaccacggucagcgccgcgugcguggcccgcaugcggggccgcaucuucaacaacaacgggaacuacggcgugaaccugaccgagcuggacgggaaccccuaccacgccuucgacucccccgccccgcucggcuuccccgacuucggcaacugcgaccugcacaugaccuucgucaagaucaaccccaacgagcugagcagcggggacccguccggcaagguggucauccacagcuacgacgccaccuucgcgccccaccucgggacggugaagcuggagaacgacgacgagcuggcccgguucgugggcaaggaggucgugcucgagcugaccuggguguccaaccgcgagggggccacccugaaccucugggccguccccaacuacggcagcucccugacccaggccagccagcuggcgcccccgaucuacccgcccggcuucggggaggccaucguguacuucacguccaccuuccccaccgugagcaaccccaagguccccugcacccucccccaggaguucgugucccacuucgugaacgagcaggcccccacgcggggcgacgccgcgcugcugcacuacgucgacccggacacccaccgcaaccucggggaguucaagauguaccccgagggcuacaugaccugcgugcccaacgccgggggcggcccccagacccugccgaucaacgggguguucgucuucaucagcugggugucccgguacuaccagcugaagcccgugggcacggccggggccgcccgccggcucggccugcgccggagcuga

SEQ ID NO: 9720 - RNA, 1608 nt, Artificial Sequence
  derived and/or modified sequence opt1 from VP1__Norovirus__AII73786
augaagauggccagcuccgacgccgcgcccagcaacgacggcgccgccgggcuggugccggaggccaacaacgagaccauggcccucgagcccgucgcgggcgccuccaucgccgcgccccugaccgggcagaacaacaucaucgaccccuggauccgccugaacuucgugcaggccccgaacggcgaguucacggugagcccccggaacucccccggggagguccuccugaaccuggagcucggccccgagcugaacccguaccuggcccaccucagccgcauguacaacggcuacgccgggggcguggaggugcagguccugcuggccgggaacgccuucaccgcgggcaagcucguguucgccgccgugccgccccacuucccccuggagaacaucucccccgggcagaucaccauguucccccacgucaucaucgacgugcggacccuggagcccgugcuccugccccugccggacguccgcaacaacuucuuccacuacaaccagcagaacgagccccggaugcgccucguggccaugcuguacacgccccugcggagcaacggcuccggcgacgacguguucaccgucagcugccgcgugcucacccggcccuccccggacuucgacuucaacuaccuggugccgcccaccgucgagagcaagacgaagcccuucacccugcccauccucaccaucggggagcugaccaacucccgcuuccccgugcccaucgacgagcuguacacgagccccaacgagucccucgugguccagccgcagaacggccggugcgcccuggacggggagcugcagggcaccacccagcuccugcccaccgcgaucugcagcuuccgcggccggaucaaccagaagguguccggggagaaccacguguggaacaugcaggucacgaacaucaacggcacccccuucgacccgaccgaggacgugcccgcgccccuggggacccccgacuucagcggcaagcuguucgggguccucucccagcgcgaccacgacaacgccugccggagccacgacgccgugaucgccacgaacagcgccaaguucaccccgaagcugggcgccauccagaucggcaccugggaggagaacgacgugcacaucaaccagcccaccaaguucacgcccgucggccucuucgaggacgagggguucaaccaguggacccugcccaacuacuccggggcccugacccucaacaugggccuggccccgcccguggcccccaccuuccccggggagcagauccuguucuuccgcagccacaucccgcucaagggcggcguggcggaccccgucaucgacugccugcugccccaggaguggauccagcaccucuaccaggaguccgcccccagccaguccgacguggcccugauccgguucacgaacccggacaccgggcgcgugcuguucgaggccaagcuccaccggagcggcuacaucaccgucgcgaacaccgggucccgccccaucguggugcccgccaacggcuacuuccgguucgacagcugggucaaccaguucuacucccuggcccccauggggacgggcaacggccgccgccgggugcaguga

SEQ ID NO: 9721 - RNA, 1623 nt, Artificial Sequence
  derived and/or modified sequence opt1 from VP1__Norovirus__AIS40019
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucgucccggcccccgggggcgaguucaccgugagcccccggaacgcgcccggggagauccugugguccgccccgcugggccccgaccucaaccccuaccugagccaccuggcccgcauguacaacggcuacgccgggggcuucgaggugcaggucauccucgccgggaacgcguucaccgccggcaaggugaucuucgccgccgugcccccgaacuuccccacggaggggcugucccccagccaggucaccauguucccccacaucgugguggacguccggcagcuggagccggugcucaucccccugcccgacgugcgcaacaacuucuaccacuacaaccaguccaacgaccccaccaucaagcugaucgccaugcucuacaccccgcugcgggcgaacaacgccggcgacgacgucuucacggugagcugccgcgugcugacccggcccucccccgacuucgacuucaucuuccucgugcccccgaccgucgagagccgcaccaagcccuucuccgugcccguccugacgguggaggagaugaccaacagccgguuccccaucccgcuggagaagcuguucaccggccccuccagcgccuucgucgugcagccccagaacgggcgcugcaccacggacggcgugcuccugggggccacccagcucuccccggucaacaucugcaccuuccggggcgacgugacccacaucacgggcagccgcaacuacaccaugaaccuggccucccagaacuggagcaacuacgaccccaccgaggagauccccgcgccccuggggaccccggacuucgugggcaagauccaggggguccucacgcagaccacccggaccgacggcagcacgcgcgggcacaaggccaccguguacaccggcuccgccgacuucgcccccaagcugggccgggugcaguucgagaccgacacggaccgcgacuucgaggccaaccagaacaccaaguucacccccgucggggugauccaggacggcagcaccacgcaccggaacgagccccagcagugggugcugccguccuacagcgggcgcaacacccccaacguccaccucgcgcccgccguggcccccaccuucccgggcgagcagcugcuguucuuccgguccaccaugcccgggugcagcggcuaccccaacauggaccucgacugccugcugccccaggagugggugcaguacuucuaccaggaggccgcgccggcccaguccgacgucgcccuccugcgcuucgugaaccccgacacgggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggaccggccgccggcgcgcgcucuga

SEQ ID NO: 9722 - RNA, 1623 nt, Artificial Sequence; identical to SEQ ID NO: 9493
  derived and/or modified sequence opt1 from VP1__Norovirus__AIV43147

SEQ ID NO: 9723 - RNA, 1623 nt, Artificial Sequence; identical to SEQ ID NO: 9497
  derived and/or modified sequence opt1 from VP1__Norovirus__AIV43148

SEQ ID NO: 9724 - RNA, 1623 nt, Artificial Sequence; identical to SEQ ID NO: 9497
  derived and/or modified sequence opt1 from VP1__Norovirus__AIV43149

SEQ ID NO: 9725 - RNA, 1623 nt, Artificial Sequence
  derived and/or modified sequence opt1 from VP1__Norovirus__AIV43150
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccaucccccuggagaagcuguucaccggccccagcuccgccuucgucgugcagccgcagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgaccccaccgaggagaucccggcgccccuggggacgcccgacuucgugggcaagauccaggggguccucacccagaccacccggacggacggcuccacccgcgggcacaaggccaccguguacaccggcagcgccgacuucgcccccaagcugggccgggugcaguucgagacggacaccgaccacgacuucgaggccaaccagaacaccaaguucaccccggucggggugauccaggacggcgggacgacccaccgcaacgagccccagcagugggugcugcccuccuacagcggccggaacacccccaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgggcccucuga

SEQ ID NO: 9726 - RNA, 1623 nt, Artificial Sequence
  derived and/or modified sequence opt1 from VP1__Norovirus__AIV43151
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggcgaacaacgccggcgacgacguguucaccgucagcugccgcgugcugacccggccgucccccgacuucgacuucaucuuccucgugccgcccaccgucgagagccgcaccaagcccuucuccgugcccgugcugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggagcaacuacgacccgaccgaggagauccccgcgccccuggggacgcccgacuucgugggcaagauccagggggugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcgggacgacccaccgcaacgagccccagcagugggugcugcccagcuacuccggccggaacaccccgaacgugcaccucgcccccgcggucgcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacguggcccuccugcgguucgucaacccggacaccgggcgcgugcuguucgagugcaagcuccacaaguccggcuacgugaccgucgcccacaccgggcagcacgaccuggugaucccgcccaacggcuacuuccgguucgacagcugggugaaccaguucuacacccuggcccccauggggaacggcacgggccgccgccgggcccucuga

SEQ ID NO: 9727 - RNA, 1623 nt, Artificial Sequence; identical to SEQ ID NO: 9493
  derived and/or modified sequence opt1 from VP1__Norovirus__AIV43152

SEQ ID NO: 9728 - RNA, 1623 nt, Artificial Sequence; identical to SEQ ID NO: 9493
  derived and/or modified sequence opt1 from VP1__Norovirus__AIV43153

SEQ ID NO: 9729 - RNA, 1623 nt, Artificial Sequence; identical to SEQ ID NO: 9493
  derived and/or modified sequence opt1 from VP1__Norovirus__AIV43154

SEQ ID NO: 9730 - RNA, 1623 nt, Artificial Sequence; identical to SEQ ID NO: 9445
  derived and/or modified sequence opt1 from VP1__Norovirus__AIV43155

SEQ ID NO: 9731 - RNA, 1623 nt, Artificial Sequence
  derived and/or modified sequence opt1 from VP1__Norovirus__AIV43156
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcuggcccggccgucccccgacuucgacuucaucuuccucgucccgcccaccguggagagccgcaccaagcccuucuccgugcccguccugaccguggaggagaugacgaacagccgguuccccaucccccuggagaagcuguucaccggcccguccagcgccuucgucgugcagccccagaacgggcgcugcaccaccgacggcgugcuccuggggacgacccagcucucccccgucaacaucugcaccuuccggggcgacgugacccacaucacgggcagccgcaacuacaccaugaaccuggccucccagaacuggagcaacuacgacccgaccgaggagauccccgcgccccuggggacccccgacuucgugggcaagauccaggggguccucacgcagaccaccaagaccgacggcagcacgcgggggcacaaggccaccguguacaccggcuccgccgacuucgccccgaagcugggccgcgugcaguucgagaccgacacggaccacgacuucgaggccaaccagaacaccaaguucacccccgucggggugauccaggacggcagcaccacgcaccggaacgagccccagcagugggugcugcccuccuacagcgggcgcaacaccccgaacguccaccucgcgcccgccguggcccccaccuuccccggcgagcagcugcuguucuuccgguccaccaugccggggugcagcggcuaccccaacauggaccucgacugccugcugccccaggagugggugcaguacuucuaccaggaggccgcgcccgcccaguccgacgucgcccuccugcgcuucgugaacccggacacgggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggaccggccggcgccgcgcgcucuga

SEQ ID NO: 9732 - RNA, 1623 nt, Artificial Sequence
  derived and/or modified sequence opt1 from VP1__Norovirus__AIV43159
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcuggcccggccgucccccgacuucgacuucaucuuccucgucccgcccaccguggagagccgcaccaagcccuucuccgugcccguccugaccguggaggagaugacgaacagccgguuccccaucccccuggagaagcuguucaccggcccguccagcgccuucgucgugcagccccagaacgggcgcugcaccaccgacggcgugcuccuggggacgacccagcucucccccgucaacaucugcaccuuccggggcgacgugacccacaucacgggcagccgcaacuacaccaugaaccuggccucccagaacuggagcaacuacgacccgaccgaggagauccccgcgccccuggggacccccgacuucgugggcaagauccaggggguccucacgcagaccacccggaccgacggcagcacgcgcgggcacaaggccaccguguacaccggcuccgccgacuucgccccgaagcugggccgggugcaguucgagaccgacacggaccacgacuucgaggccaaccagaacaccaaguucacccccgucggggugauccaggacggcagcaccacgcaccgcaacgagccccagcagugggugcugcccuccuacagcgggcggaacaccccgaacguccaccucgcgcccgccguggcccccaccuuccccggcgagcagcugcuguucuuccgcuccaccaugccggggugcagcggcuaccccaacauggaccucgacugccugcugccccaggagugggugcaguacuucuaccaggaggccgcgcccgcccaguccgacgucgcccuccugcgguucgugaacccggacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgggcgcucuga

SEQ ID NO: 9733 - RNA, 1623 nt, Artificial Sequence
  derived and/or modified sequence opt1 from VP1__Norovirus__AIV43160
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugauccacaucacgggcagccgcaacuacaccaugaaccuggccucccagaacuggagcaacuacgacccgaccgaggagauccccgcgccccuggggacccccgacuucgugggcaagauccaggggguccucacgcagaccacccggaccgacggcagcacgcgcgggcacaaggccaccguguacaccggcuccgccgacuucgccccgaagcugggccgggugcaguucgagaccgacacggaccacgacuucgaggccaaccagaacaccaaguucacccccgucggggugauccaggacggcagcaccacgcaccgcaacgagccccagcagugggugcugcccuccuacagcgggcggaacaccccgaacguccaccucgcccccgcgguggcccccaccuuccccggcgagcagcugcuguucuuccgcuccaccaugccggggugcagcggcuaccccaacauggaccucgacugccugcugccccaggagugggugcaguacuucuaccaggaggccgcccccgcgcaguccgacgucgcccuccugcgguucgugaacccggacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgggcccucuga

SEQ ID NO: 9734 - RNA, 1623 nt, Artificial Sequence; identical to SEQ ID NO: 9733
  derived and/or modified sequence opt1 from VP1__Norovirus__AIV43161

SEQ ID NO: 9735 - RNA, 1623 nt, Artificial Sequence; identical to SEQ ID NO: 9493
  derived and/or modified sequence opt1 from VP1__Norovirus__AIV43162

SEQ ID NO: 9736 - RNA, 1623 nt, Artificial Sequence; identical to SEQ ID NO: 9493
  derived and/or modified sequence opt1 from VP1__Norovirus__AIV43163

SEQ ID NO: 9737 - RNA, 1623 nt, Artificial Sequence; identical to SEQ ID NO: 9733
  derived and/or modified sequence opt1 from VP1__Norovirus__AIV43164

SEQ ID NO: 9738 - RNA, 1623 nt, Artificial Sequence
  derived and/or modified sequence opt1 from VP1__Norovirus__AIV43165
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcagcaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacaccccgaacguccaccucgcccccgcgguggcccccaccuuccccggggagcagcugcuguucuuccgcuccacgaugccgggcugcagcggcuaccccaacauggaccucgacugccugcugccccaggagugggugcaguacuucuaccaggaggccgcccccgcgcaguccgacgucgcccuccugcgguucgugaacccggacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgggcccucuga

SEQ ID NO: 9739 - RNA, 1623 nt, Artificial Sequence
  derived and/or modified sequence opt1 from VP1__Norovirus__AIV43166
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccauccugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggagcaacuacgacccgaccgaggagauccccgcgccccuggggacgcccgacuucgugggcaagauccagggggugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcagcacgacccaccgcaacgagccccagcagugggugcugcccuccuacagcgggcggaacaccccgaacgugcaccucgcccccgcggucgcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacguggcccuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgggcccucuga

SEQ ID NO: 9740 - RNA, 1623 nt, Artificial Sequence
  derived and/or modified sequence opt1 from VP1__Norovirus__AIV43167
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgagaccaaccagaacaccaaguucacgcccgucggggugauccaggacggcagcaccacccaccgcaacgagccccagcagugggugcugcccuccuacagcgggcggaacaccccgaacguccaccucgcccccgccguggcgcccacguuccccggcgagcagcugcuguucuuccgcuccaccaugccggggugcagcggcuaccccaacauggaccucgacugccugcugccccaggagugggugcaguacuucuaccaggaggccgcccccgcccaguccgacgucgcgcuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacgcuggcccccaugggcaacgggaccggccgccgccgggcccucuga

SEQ ID NO: 9741 - RNA, 1623 nt, Artificial Sequence
  derived and/or modified sequence opt1 from VP1__Norovirus__AIV43171
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccacccgcacggacggcagcacccgggggcacaaggccaccguguacaccggcagcgccgacuucgccccgaagcugggccgcgugcaguucgagacggacaccaaccacgacuucgaggccaaccagaacaccaaguucacccccgucggggugauccaggacggcgggacgacccaccggaacgagccccagcagugggugcugcccuccuacagcggccgcaacaccccgaacguccaccucgcccccgcgguggcccccaccuuccccggggagcagcugcuguucuuccgguccacgaugccgggcugcagcggcuaccccaacauggaccucgacugccugcugccccaggagugggugcaguacuucuaccaggaggccgcccccgcgcaguccgacgucgcccuccugcgcuucgugaacccggacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccggcgccgcgcccucuga

SEQ ID NO: 9742 - RNA, 1623 nt, Artificial Sequence
  derived and/or modified sequence opt1 from VP1__Norovirus__AIV43172
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggaugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcagcacgacccaccgcaacgagccccagcagugggugcugcccuccuacagcgggcggaacaccccgaacgugcaccucgcccccgcggucgcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacguggcccuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgggcccucuga

SEQ ID NO: 9743 - RNA, 1623 nt, Artificial Sequence
  derived and/or modified sequence opt1 from VP1__Norovirus__AIV43173
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccacccgcacggacggcagcacccgggggcacaaggccaccguguacaccggcagcgccgacuucgccccgaagcugggccgcauccaguucgagacggacaccaaccacgacuucgaggccaaccagaacaccaaguucacccccgugggggucauccaggacggcgggacgacccaccggaacgagccccagcagugggugcugcccuccuacagcggccgcaacaccccgaacgugcaccucgcccccgcggucgcccccaccuuccccggggagcagcugcuguucuuccgguccacgaugccgggcugcagcggcuaccccaacauggaccucgacugccugcugccccaggagugggugcaguacuucuaccaggaggccgcccccgcgcaguccgacguggcccuccugcgcuucgucaacccggacaccgggcgggugcuguucgagugcaagcuccacaagagcggcuacgugaccgucgcccacaccgggcagcacgaccuggugaucccgcccaacggcuacuuccgcuucgacuccugggugaaccaguucuacacccuggcccccauggggaacggcacgggccggcgccgcgcccucuga

SEQ ID NO: 9744 - RNA, 1623 nt, Artificial Sequence
  derived and/or modified sequence opt1 from VP1__Norovirus__AIV43174
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucuccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacaccccgaacguccaccucgcccccgccguggcgcccaccuuccccggggagcagcugcuguucuuccgcagcacgaugccgggcugcuccggcuaccccaacauggaccucgacugccugcugccccaggagugggugcaguacuucuaccaggaggccgcccccgcccagagcgacgucgcgcuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgggcccucuga

SEQ ID NO: 9745 - RNA, 1623 nt, Artificial Sequence; identical to SEQ ID NO: 9744
  derived and/or modified sequence opt1 from VP1__Norovirus__AIV43175

SEQ ID NO: 9746 - RNA, 1623 nt, Artificial Sequence; identical to SEQ ID NO: 9493
  derived and/or modified sequence opt1 from VP1__Norovirus__AIV43176

SEQ ID NO: 9747 - RNA, 1623 nt, Artificial Sequence; identical to SEQ ID NO: 9688
  derived and/or modified sequence opt1 from VP1__Norovirus__AIV43177

SEQ ID NO: 9748 - RNA, 1623 nt, Artificial Sequence; identical to SEQ ID NO: 9742
  derived and/or modified sequence opt1 from VP1__Norovirus__AIV43178

SEQ ID NO: 9749 - RNA, 1623 nt, Artificial Sequence
  derived and/or modified sequence opt1 from VP1__Norovirus__AIV43179
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggacauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgggcccucuga

SEQ ID NO: 9750 - RNA, 1623 nt, Artificial Sequence
  derived and/or modified sequence opt1 from VP1__Norovirus__AIY27747
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcagcacgacccaccgcaacgagccccagcagugggugcugcccuccuacagcgggcggaacaccccgaacguccaccucgcccccgcgguggcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacgucgcccuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgggcccucuga

SEQ ID NO: 9751 - RNA, 1623 nt, Artificial Sequence; identical to SEQ ID NO: 9744
  derived and/or modified sequence opt1 from VP1__Norovirus__AJA71387

SEQ ID NO: 9752 - RNA, 1623 nt, Artificial Sequence
  derived and/or modified sequence opt1 from VP1__Norovirus__AJA71388
augaagauggccagcuccgacgccaaccccagcgacggcuccgcggccaaccuggugcccgaggucaacaacgaggugcucgcccuggagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccucggcccggaccugaaccccuaccugagccaccucgcccgcauguacaacggcuacgccgggggcuucgaggugcaggucauccuggccgggaacgccuucaccgccggcaaggugaucuucgccgccgugccgcccaacuucccgacggaggggcugucccccagccaggucaccauguucccccacaucgugguggacguccggcagcucgagcccgugcugaucccgcugcccgacgugcgcaacaacuucuaccacuacaaccaguccaacgaccccaccaucaagcucaucgccaugcuguacacgccccugcgggcgaacaacgccggcgacgacgucuucaccgugagcugccgcgugcucacccggccgucccccgacuucgacuucaucuuccuggucccgcccaccguggagagccgcaccaagcccuucuccgugcccauccugacggucgaggagaugaccaacagccgguuccccaucccccucgagaagcuguucaccggcccguccagcgccuucgugguccagccccagaacgggcgcugcaccacggacggcgugcugcucgggaccacccagcugucccccgugaacaucugcaccuuccggggcgacgucacgcacaucaccggcagccacaacuacaccaugaaccuggccucccagaacuggagcaacuacgacccgaccgaggagauccccgcgccccucgggacgcccgacuucgugggcaagauccagggggugcugacccagaccacccgcacggacggcagcacccgggggcacaaggccaccgucuacaccggcuccgccgacuucgccccgaagcugggccgcgugcaguucgagacggacaccgaccgggacuucgaggccaaccagaacaccaaguucacccccgugggggucauccaggacggcgggacgacccaccgcaacgagccccagcagugggugcuccccagcuacuccggccggaacaccccgaacgugcaccuggcccccgcggucgcccccaccuuccccggggagcagcuccuguucuuccgcagcacgaugccgggcugcuccggcuaccccaacauggaccuggacugccugcucccccaggagugggugcaguacuucuaccaggaggccgcccccgcgcagagcgacguggcccugcugcgguucgucaacccggacaccgggcgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgccgccgggcccuguga

SEQ ID NO: 9753 - RNA, 1623 nt, Artificial Sequence; identical to SEQ ID NO: 9742
  derived and/or modified sequence opt1 from VP1__Norovirus__AJA71389

SEQ ID NO: 9754 - RNA, 1623 nt, Artificial Sequence
  derived and/or modified sequence opt1 from VP1__Norovirus__AJA71390
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggccugcugcucgggaccacccagcugucccccgugaacaucugcaccuuccggggcgacgucacgcacaucaccggcagccgcaacuacaccaugaaccuggccucccagaacuggagcaacuacgacccgaccgaggagauccccgcgccccucgggacgcccgacuucgugggcaagauccagggggugcugacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcgggacgacccaccgcaacgagccccagcagugggugcuccccagcuacuccggccggaacaccccgaacgugcaccuggcccccgcggucgcccccaccuuccccggggagcagcuccucuucuuccgcagcacgaugccgggcugcuccggcuaccccaacauggaccuggacugccugcucccccaggagugggugcaguacuucuaccaggaggccgcccccgcgcagagcgacguggcccugcugcgguucgucaacccggacaccgggcgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgccgccgggcccuguga

SEQ ID NO: 9755 - RNA, 1623 nt, Artificial Sequence; identical to SEQ ID NO: 9493
  derived and/or modified sequence opt1 from VP1__Norovirus__AJA71392

SEQ ID NO: 9756 - RNA, 1623 nt, Artificial Sequence; identical to SEQ ID NO: 9497
  derived and/or modified sequence opt1 from VP1__Norovirus__AJA71393

SEQ ID NO: 9757 - RNA, 1623 nt, Artificial Sequence
  derived and/or modified sequence opt1 from VP1__Norovirus__AJA71394
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcacggacggcagcacccgggggcacaaggccaccguguacaucggcuccgccgacuucgccccgaagcugggccgcgugcaguucgagaccgacacgaaccacgacuucgaggccaaccagaacaccaaguucacccccgucggggugauccaggacggcgggaccacgcaccggaacgagccccagcagugggugcugcccagcuacuccggccgcaacaccccgaacguccaccucgcccccgcgguggcccccaccuuccccggggagcagcugcuguucuuccggagcaccaugccgggcugcuccggcuaccccaacauggaccucgacugccugcugccccaggagugggugcaguacuucuaccaggaggccgcccccgcgcagagcgacgucgcccuccugcgcuucgugaacccggacacggggcgggugcuguucgagugcaagcuccacaaguccggcuacgucaccguggcccacaccgggcagcacgaccuggugaucccgcccaacggcuacuuccgcuucgacagccgggucaaccaguucuacacccuggcccccauggggaacggcaccggccgccgccgggcccucuga

SEQ ID NO: 9758 - RNA, 1623 nt, Artificial Sequence; identical to SEQ ID NO: 9688
  derived and/or modified sequence opt1 from VP1__Norovirus__AJA71395

SEQ ID NO: 9759 - RNA, 1623 nt, Artificial Sequence
  derived and/or modified sequence opt1 from VP1__Norovirus__AJA71396
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggaugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcagcacgacccaccgcaacgagccccagcagugggugcugcccuccuacagcgggcggaacaccccgaacgugcaccucgcccccgcggucgcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacguggcccuccugcgguucgucaacccggacaccggccgcgugcuguucgagugcaagcuccacaagagcggguacgugaccgucgccuacaccggccagcacgaccuggugaucccgcccaacggguacuuccgguucgacuccugggugaaccaguucuacacccuggcccccaugggcaacgggacgggccgccgccgggcccucuga

SEQ ID NO: 9760 - RNA, 1623 nt, Artificial Sequence
  derived and/or modified sequence opt1 from VP1__Norovirus__AJA71399
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgccguggacgugcggcagcuggagcccguccucaucccgcugcccgacgugcgcaacaacuucuaccacuacaaccaguccaacgaccccaccaucaagcugaucgcgaugcucuacacgccccugcgggccaacaacgccggcgacgacguguucaccgucagcugccgcgugcugacccggccgucccccgacuucgacuucaucuuccucgugccgcccaccgucgagagccgcaccaagcccuucuccgugcccgugcugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggagcaacuacgacccgaccgaggagauccccgcgccccuggggacgcccgacuucgugggcaagauccagggggugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcgggacgacccaccgcaacgagccccagcagugggugcugcccagcuacuccggccggaacaccccgaacgugcaccucgcgcccgccgucgcccccaccuuccccggggagcagcugcuguucuuccgcagcacgaugccgggcugcuccggcuaccccaacauggaccucgacugccugcugccccaggagugggugcaguacuucuaccaggaggccgcgcccgcccagagcgacguggcccuccugcgguucgucaacccggacaccgggcgcgugcuguucgagugcaagcuccacaaguccggcuacgugaccgucgcccacaccgggcagcacgaccuggugaucccgcccaacggcuacuuccgguucgacagcugggugaaccaguucuacacccuggcccccauggggaacggcacgggccgccgccgggcgcucuga

SEQ ID NO: 9761 - RNA, 1623 nt, Artificial Sequence
  derived and/or modified sequence opt1 from VP1__Norovirus__AJA71400
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgagaccaaccagaacaccaaguucacgcccgucggggugauccaggacggcgggaccacccaccggaacgagccccagcagugggugcugcccagcuacuccggccgcaacaccccgaacguccaccucgcccccgccguggcgcccacguuccccggggagcagcugcuguucuuccggagcaccaugccgggcugcuccggcuaccccaacauggaccucgacugccugcugccccaggagugggugcaguacuucuaccaggaggccgcccccgcccagagcgacgucgcgcuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacgcuggcccccauggggaacggcaccggccgccggcgcgcccucuga

SEQ ID NO: 9762 - RNA, 1623 nt, Artificial Sequence
  derived and/or modified sequence opt1 from VP1__Norovirus__AJA71401
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacaucacgcacaucaccggcagccgcaacuacaccaugaaccuggccucccagaacuggagcaacuacgacccgaccgaggagauccccgcgccccuggggacgcccgacuucgugggcaagauccagggggugcucacccagaccacccggacggacggcagcacccgcgggcacaaggccaccgucuacaccggcuccgccgacuucgccccgaagcugggccgggugcaguucgggacggacaccgaccacgacuucgaggccaaccagaacaccaaguucacccccgugggcgucauccaggacgggagcacgacccaccgcaacgagccccagcagugggugcugcccuccuacagcggccggaacaccccgaacgugcaccucgcccccgcggucgcccccaccuuccccggggagcagcugcuguucuuccgcuccacgaugccgggcugcagcggcuaccccaacauggaccucgacugccugcugccccaggagugggugcaguacuucuaccaggaggccgcccccgcgcaguccgacguggcccuccugcgguucgucaacccggacaccgggcgcgugcuguucgagugcaagcuccacaagagcggcuacgugaccgucgcccacaccgggcagcacgaccuggugaucccgcccaacggcuacuuccgguucgacuccugggugaaccaguucuacacccuggcccccauggggaacggcacgggccgccgccgggcccucuga

SEQ ID NO: 9763 - RNA, 1623 nt, Artificial Sequence; identical to SEQ ID NO: 9497
  derived and/or modified sequence opt1 from VP1__Norovirus__AJA71402

SEQ ID NO: 9764 - RNA, 1623 nt, Artificial Sequence
  derived and/or modified sequence opt1 from VP1__Norovirus__AJA71403
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccaucgagagccgcaccaagcccuucuccgugcccgugcugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggaacaacuacgacccgaccgaggagauccccgcgccccuggggacgcccgacuucgugggcaagauccagggggugcucacccagaccacccggacggacggcagcacccgcgggcacaaggccaccgucuacaccggcagcgccgacuucuccccgaagcugggccgggugcaguucgagacggacaccgaccacgacuucgaggccaaccagaacaccaaguucacccccgugggggucauccaggacggcgggacgacccaccgcaacgagccccagcagugggugcugcccagcuacuccggccggaacaccccgaacgugcaccucgcccccgccgucgcgcccaccuuccccggggagcagcugcuguucuuccgcagcacgaugccgggcugcuccggcuaccccaacauggaccucgacugccugcugccccaggagugggugcaguacuucuaccaggaggccgcccccgcccagagcgacguggcgcuccugcgguucgucaacccggacaccgggcgcgugcuguucgagugcaagcuccacaaguccggcuacgugaccgucgcccacaccgggcagcacgaccuggugaucccgcccaacggcuacuuccgguucgacagcugggugaaccaguucuacacccuggcccccauggggaacggcacgggccgccgccgggcccucuga

SEQ ID NO: 9765 - RNA, 1623 nt, Artificial Sequence; identical to SEQ ID NO: 9761
  derived and/or modified sequence opt1 from VP1__Norovirus__AJA71404

SEQ ID NO: 9766 - RNA, 1623 nt, Artificial Sequence
  derived and/or modified sequence opt1 from VP1__Norovirus__AJA71405
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccagaccaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcacgaagcccuucagcgugcccguccugaccguggaggagaugaccaacucccgguuccccaucccccuggagaagcuguucaccggcccgagcuccgccuucgucgugcagccccagaacgggcgcugcacgaccgacggcgugcuccuggggaccacccagcucagccccgucaacaucugcacguuccggggcgacgugacccacaucaccggcucccgcaacuacaccaugaaccuggccagccagaacuggaacaacuacgacccgacggaggagauccccgcgccccuggggauccccgacuucgugggcaagauccaggggaugcucacccagaccacccggacggacggcuccacccgcgggcacaaggccaccgucuacaccggcagcguggacuucgccccgaagcugggccgggugcaguucgagacggacaccgaccacgacuucgaggccaaccagaacaccaaguucacccccgucggggugauccaggacggcagcacgacccaccgcaacgagccccagcagugggugcugcccuccuacagcgggcggaacaccccgaacguccaccucgcccccgccguggcgcccaccuuccccggcgagcagcugcuguucuuccgcuccacgaugccggggugcagcggcuaccccaacauggaccucgacugccugcugccccaggagugggugcaguacuucuaccaggaggccgcccccgcccaguccgacgucgcgcuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgggcccucuga

SEQ ID NO: 9767 - RNA, 1623 nt, Artificial Sequence
  derived and/or modified sequence opt1 from VP1__Norovirus__AJA71406
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacaccccgaacguccaccucgcccccgcgguggcccccaccuuccccggcgagcagcugcuguucuuccgcagcacgaugccggggugcuccggcuaccccaacauggaccucgacugccugcugccccaggagugggugcaguacuucuaccaggaggccgcccccgcgcagagcgacgucgcccuccugcgguucgugaacccggacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgggcccucuga

SEQ ID NO: 9768 - RNA, 1623 nt, Artificial Sequence
  derived and/or modified sequence opt1 from VP1__Norovirus__AJA71407
augaagauggccagcuccgacgccacccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucacggccggcaaggugaucuucgccgccgugccgcccaacuucccgaccgaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcacgaagcccuucuccgugcccguccugaccguggaggagaugaccaacagccgguuccccaucccccuggagaagcuguucaccggcccguccagcgccuucgucgugcagccccagaacgggcgcugcacgaccgacggcgugcuccuggggaccacccagcucucccccgucaacaucugcacguuccggggcgacgugacccacaucaccggcagccacaacuacaccaugaaccuggccucccagaacuggaacaacuacgacccgacggaggagauccccgcgccccuggggacccccgacuucgugggcaagauccaggggguccucacccagaccacgcgcaccgacggcagcacccgggggcacaaggccaccguguacacgggcagcgccgacuucgccccgaagcugggccgcgugcaguucgagaccgacaccaaccacgacuucgaggccaaccagaacaccaaguucacgcccgucggggugauccaggacggcuccaccacccaccggaacgagccccagcagugggugcugcccagcuacuccgggcgcaacacccacaacguccaccucgccccggcgguggcccccacguuccccggcgagcagcugcuguucuuccggagcaccaugcccgggugcuccggcuacccgaacauggaccucgacugccugcugccccaggagugggugcaguacuucuaccaggaggccgcccccgcgcagagcgacgucgcccuccugcgcuucgugaaccccgacaccggccgggugcuguucgagugcaagcuccacaaguccggguacgucaccguggcccacaccggccagcacgaccuggugaucccgcccaacggguacuuccgcuucgacagcugggucaaccaguucuacacgcuggcccccaugggcaacgggaccggccggcgccgcgccguguga

SEQ ID NO: 9769 - RNA, 1623 nt, Artificial Sequence; identical to SEQ ID NO: 9764
  derived and/or modified sequence opt1 from VP1__Norovirus__AJA71408

SEQ ID NO: 9770 - RNA, 1623 nt, Artificial Sequence; identical to SEQ ID NO: 9761
  derived and/or modified sequence opt1 from VP1__Norovirus__AJA71409

SEQ ID NO: 9771 - RNA, 1623 nt, Artificial Sequence
  derived and/or modified sequence opt1 from VP1__Norovirus__AJA71410
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcacggacggcagcacccgggggcacaaggccaccguguacaccggcuccgccgacuucgccccgaagcugggccgcgugcaguucgagacggacaccgaccgggacuucgaggccaaccagaacaccaaguucacccccgucggggugauccaggacggcgggacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgggcccucuga

SEQ ID NO: 9772 - RNA, 1623 nt, Artificial Sequence; identical to SEQ ID NO: 9688
  derived and/or modified sequence opt1 from VP1__Norovirus__AJA71411

SEQ ID NO: 9773 - RNA, 1623 nt, Artificial Sequence
  derived and/or modified sequence opt1 from VP1__Norovirus__AJA71412
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaagaccggcuacgucaccguggcccacaccgggcagcacgaccuggugaucccgcccaacggcuacuuccgguucgacuccugggucaaccaguucuacacgcuggcccccauggggaacggcaccggccgccgccgggcccucuga

SEQ ID NO: 9774 - RNA, 1623 nt, Artificial Sequence; identical to SEQ ID NO: 9493
  derived and/or modified sequence opt1 from VP1__Norovirus__AJA71413

SEQ ID NO: 9775 - RNA, 1623 nt, Artificial Sequence; identical to SEQ ID NO: 9445
  derived and/or modified sequence opt1 from VP1__Norovirus__AJA71416

SEQ ID NO: 9776 - RNA, 1623 nt, Artificial Sequence
  derived and/or modified sequence opt1 from VP1__Norovirus__AJA71417
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccugaccucccagaacuggagcaacuacgacccgacggaggagauccccgcgccccuggggacccccgacuucgugggcaagauccaggggaugcucacccagaccacgcggaccgacggcagcacccgcgggcacaaggccaccgucuacacgggcuccgccgacuucgccccgaagcugggccgggugcaguucgagaccgacaccgaccacgacuucgaggccaaccagaacaccaaguucacgcccgugggggucauccaggacggcagcaccacccaccgcaacgagccccagcagugggugcugcccuccuacagcgggcggaacaccccgaacgugcaccucgcccccgccgucgcgcccacguuccccggcgagcagcugcuguucuuccgcuccaccaugccggggugcagcggcuaccccaacauggaccucgacugccugcugccccaggagugggugcaguacuucuaccaggaggccgcccccgcccaguccgacguggcgcuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacgcuggcccccaugggcaacgggaccggccgccgccgggcccucuga

SEQ ID NO: 9777 - RNA, 1623 nt, Artificial Sequence
  derived and/or modified sequence opt1 from VP1__Norovirus__AJA71418
augaagauggccagcuccgacgccagccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacaccccgaacguccaccucgcccccgcgguggcccccaccuuccccggggagcagcugcuguucuuccgcuccacgaugccgggcugcagcggcuaccccaacauggaccucgacugccugcugccccaggagugggugcaguacuucuaccaggaggccgcccccgcgcaguccgacgucgcccuccugcgguucgugaacccggacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgggcccucuga

SEQ ID NO: 9778 - RNA, 1623 nt, Artificial Sequence; identical to SEQ ID NO: 9777
  derived and/or modified sequence opt1 from VP1__Norovirus__AJA71419

SEQ ID NO: 9779 - RNA, 1623 nt, Artificial Sequence; identical to SEQ ID NO: 9493
  derived and/or modified sequence opt1 from VP1__Norovirus__AJA71420

SEQ ID NO: 9780 - RNA, 1623 nt, Artificial Sequence; identical to SEQ ID NO: 9688
  derived and/or modified sequence opt1 from VP1__Norovirus__AJA71421

SEQ ID NO: 9781 - RNA, 1623 nt, Artificial Sequence; identical to SEQ ID NO: 9764
  derived and/or modified sequence opt1 from VP1__Norovirus__AJA71422

SEQ ID NO: 9782 - RNA, 1623 nt, Artificial Sequence
  derived and/or modified sequence opt1 from VP1__Norovirus__AJA71423
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggaugcucacccagaccacccggacggacggcagcacccgcgggcacaaggccaccgucuacaucggcggcgccgacuucgccccgaagcuggggcgggugcaguucgagaccgacacggaccacgacuucgaggccaaccagaacaccaaguucacccccgugggcgucauccaggacggguccaccacgcaccgcaacgagccccagcagugggugcugcccagcuacuccggccggaacaccccgaacgugcaccucgcccccgcggucgcccccaccuuccccggggagcagcugcuguucuuccgcagcaccaugccgggcugcuccggcuaccccaacauggaccucgacugccugcugccccaggagugggugcaguacuucuaccaggaggccgcccccgcgcagagcgacguggcccuccugcgguucgucaacccggacacggggcgcgugcuguucgagugcaagcuccacaaguccggcuacgugaccgucgcccacaccgggcagcacgaccuggugaucccgcccaacggcuacuuccgguucgacagcugggugaaccaguucuacacccuggcccccauggggaacggcaccggccgccgccgggcccucuga

SEQ ID NO: 9783 - RNA, 1623 nt, Artificial Sequence
  derived and/or modified sequence opt1 from VP1__Norovirus__AJA71424
augaagauggccagcuccgacgccaaccccagcgacggcuccgcggccaaccuggugcccgaggucagcaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggaugcucacccagaccacccggacggacggcuccacccgcgggcacaaggccaccgucuacaccggcagcgccgacuucgccccgaagcugggccgggugcaguucgagacggacaccgaccacgacuucgaggccaaccagaacaccaaguucacccccgugggggucauccaggacggcuccacgacccaccgcaacgagccccagcagugggugcugcccagcuacuccgggcggaacaccccgaacgugcaccucgcccccgcggucgcccccaccuuccccggcgagcagcugcuguucuuccgcagcacgaugccggggugcuccggcuaccccaacauggaccucgacugccugcugccccaggagugggugcaguacuucuaccaggaggccgcccccgcgcagagcgacguggcccuccugcgguucgucaacccggacaccggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggacgggccgcaagcgcgcccucuga

SEQ ID NO: 9784 - RNA, 1623 nt, Artificial Sequence
  derived and/or modified sequence opt1 from VP1__Norovirus__AJA71425
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccgucccccuggagaagcuguucaccggcccguccagcgccuucguggugcagccccagaacgggcgcugcaccacggacggcguccuccuggggaccacccagcucucccccgugaacaucugcaccuuccggggcgacgugacgcacaucaccggcagccacaacuacaccaugaaccuggccucccagaacuggagcaacuacgacccgaccgaggagauccccgcgccccuggggacgcccgacuucgucggcaagauccagggggugcucacccagaccacccgcacggacggcagcacccgggggcacaaggccaccguguacaccggcuccgccgacuucgccccgaagcugggccgcguccaguucgagacggacaccgaccgggacuucgaggccaaccagaacaccaaguucacccccgugggggugauccaggacggcgggacgacccaccgcaacgagccccagcaguggguccugcccagcuacuccggccggaacaccccgaacgugcaccucgcccccgcgguggcccccaccuuccccggggagcagcugcuguucuuccgcagcacgaugccgggcugcuccggcuaccccaacauggaccucgacugccugcugccccaggaguggguccaguacuucuaccaggaggccgcccccgcgcagagcgacguggcccuccugcgguucgugaacccggacaccgggcgcguccuguucgagugcaagcuccacaaguccggcuacgugaccguggcccacaccgggcagcacgaccuggucaucccgcccaacggcuacuuccgguucgacagcugggugaaccaguucuacacccuggcccccauggggaacggcacgggccgccgccgggcccucuga

SEQ ID NO: 9785 - RNA, 1623 nt, Artificial Sequence
  derived and/or modified sequence opt1 from VP1__Norovirus__AJA71426
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcagcuacgacccgaccgaggagauccccgcgccccuggggacgcccgacuucgugggcaagauccaggggaugcucacccagaccacccggacggacggcuccacccgcgggcacaaggccaccgucuacaccggcagcgccgacuucgccccgaagcugggccgggugcaguucgagacggacaccgaccacgacuucgaggccaaccagaacaccaaguucacccccgugggggucauccaggacggcuccacgacccaccgcaacgagccccagcagugggugcugcccagcuacuccgggcggaacaccccgaacgugcaccucgcccccgcggucgcccccaccuuccccggcgagcagcugcuguucuuccgcagcacgaugccggggugcuccggcuaccccaacauggaccucgacugccugcugccccaggagugggugcaguacuucuaccaggaggccgcccccgcgcagagcgacguggcccuccugcgguucgucaacccggacaccggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggacgggccgccgccgggcccucuga

SEQ ID NO: 9786 - RNA, 1623 nt, Artificial Sequence
  derived and/or modified sequence opt1 from VP1__Norovirus__AJA71427
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacugggggaacuacgacccgaccgaggagauccccgcgccccugggcacgcccgacuucguggggaagauccagggcguccucacccagaccacccggacggacgggagcacccgcggccacaaggccaccguguacaccggcagcgccgacuucgccccgaagcuggggcgggugcaguucgagacggacaccgaccacgacuucgaggccaaccagaacaccaaguucacccccgucggcgugauccaggacggguccacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgggcccucuga

SEQ ID NO: 9787 - RNA, 1623 nt, Artificial Sequence; identical to SEQ ID NO: 9771
  derived and/or modified sequence opt1 from VP1__Norovirus__AJA71428

SEQ ID NO: 9788 - RNA, 1623 nt, Artificial Sequence
  derived and/or modified sequence opt1 from VP1__Norovirus__AJA71429
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucaucguccagccccagaacgggcgcugcacgaccgacggcgugcuccuggggaccacccagcucucccccgucaacaucugcacguuccggggcgacgugacccacaucagcggcucccgcaacuacaccaugaaccuggccagccagaacuggaacagcuacgacccgaccgaggagacgcccgcgccccuggggacccccgacuucgugggcaagauccaggggguccucacccagaccacgcggaccgacggcuccacccgcgggcacaaggccaccguguacacgggcagcgccgacuucuccccgaagcugggccgggugcaguucgccaccgacaccgacaacgacuucgucaccaaccagaacacgaaguucacccccgugggggugauccaggacggcagcaccacgccccgcaacgagccccagcaguggguccugccguccuacagcgggcggaacacccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagaccggguacgugacgguggcgcacaccggccagcacgaccuggucaucccgcccaacggguacuuccgguucgacagcugggugaaccaguucuacacccuggcccccaugggcaacgggaccggccgccgccgggugcucuga

SEQ ID NO: 9789 - RNA, 1623 nt, Artificial Sequence
  derived and/or modified sequence opt1 from VP1__Norovirus__AJA71430
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcacggacggcagcacccgggggcacaaggccaccguguacaccggcuccgccgacuucgccccgaagcugggccgcgugcaguucgagacggacaccaaccacgacuucgacgccaaccagaacaccaaguucacccccgucggggugauccaggacggcgggacgacccaccggaacgagccccagcagugggugcugcccagcuacuccggccgcaacaccccgaacguccaccucgcccccgcgguggcccccaccuuccccggggagcagcugcuguucuuccggagcacgaugccgggcugcuccggcuaccccaacauggaccucgacugccugcugccccaggagugggugcaguacuucuaccaggaggccgcccccgcgcagagcgacgucgcccuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacccuggcccccauggggaacggcacgggccggcgccgcgcccucuga

SEQ ID NO: 9790 - RNA, 1623 nt, Artificial Sequence
  derived and/or modified sequence opt1 from VP1__Norovirus__AJA71456
augaagauggccagcuccgacgccaaccccagcgacggcuccgcggccaaccuggugcccgaggucaacaacgaggugauggcccucgagcccguggucggggccaccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaaggugaucuucgccgccgugccgcccaacuucccgaccgaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggccaacaacgcgggcgacgacgucuucaccgugagcugccgcgugcugacccggccgucccccgacuucgacuucaucuuccucgucccgcccaccguggagagccgcacgaagcccuucuccgugcccauccugaccgucgaggagaugaccaacagccgguuccccaucccccuggagaagcuguucaccggcccguccagcgccuucgugguccagccccagaacgggcgcugcacgaccgacggcgugcuccuggggaccacccagcucucccccgugaacaucugcacguuccggggcgacgucacccacaucaccggcagccgcaacuacaccaugaaccuggccucccagaacuggagcaacuacgacccgacggaggagauccccgcgccccuggggauccccgacuucgugggcaagauccaggggaugcucacccagaccacccggacggacggcagcacccgcgggcacaaggccaccguguacaccggcuccgccgacuucgccccgaagcugggccggguccaguucgagacggacaccgaccacgacuucgaggccaaccagaacaccaaguucacccccgugggggugauccaggacggcagcacgacccaccgcaacgagccccagcaguggguccugcccuccuacagcgggcggaacaccccgaacgugcaccucgcccccgccguggcgcccaccuuccccggcgagcagcugcuguucuuccgcuccacgaugccggggugcagcggcuaccccaacauggaccucgacugccugcugccccaggaguggguccaguacuucuaccaggaggccgcccccgcccaguccgacguggcgcuccugcgguucgugaacccggacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccgggcccucuga

SEQ ID NO: 9791 - RNA, 1623 nt, Artificial Sequence
  derived and/or modified sequence opt1 from VP1__Norovirus__AJA71457
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcagcacgacccaccgcaacgagccccagcagugggugcugcccuccuacagcgggcggaacaccccgaacguccaccucgcccccgcgguggcccccaccuuccccggcgagcagcugcuguucuuccgcuccacgaugccggggugcagcggcuaccccuccauggaccucgacugccugcugccccaggagugggugcaguacuucuaccaggaggccgcccccgcgcagagcgacgucgcccuccugcgguucgugaacccggacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgggcccucuga

SEQ ID NO: 9792 - RNA, 1623 nt, Artificial Sequence
  derived and/or modified sequence opt1 from VP1__Norovirus__AJA71458
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccggccgaggagauccccgcgccccuggggacccccgacuucgugggcaagauccaggggguccucacgcagaccacccgcaccgacggcagcacgcgggggcacaaggccaccguguacaccggcuccgccgacuucgccccgaagcugggccgcgugcaguucgagaccgacacggaccgggacuucgaggccaaccagaacaccaaguucacccccgucggggugauccaggacggcgggaccacgcaccgcaacgagccccagcagugggugcugcccagcuacuccggccggaacaccccgaacguccaccucgcgcccgccguggcccccaccuuccccggggagcagcugcuguucuuccgcagcaccaugccgggcugcuccggcuaccccaacauggaccucgacugccugcugccccaggagugggugcaguacuucuaccaggaggccgcgcccgcccagagcgacgucgcccuccugcgguucgugaacccggacacggggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcaccggccgccgccgggcgcucuga

SEQ ID NO: 9793 - RNA, 1623 nt, Artificial Sequence
  derived and/or modified sequence opt1 from VP1__Norovirus__AJA71459
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccguggacuucgccccgaagcugggccggguccaguucgagacggacaccgaccacgacuucgaggccaaccagaacaccaaguucacccccgugggggugauccaggacggcagcacgacccaccgcaacgagccccagcaguggguccugcccuccuacagcgggcggaacaccccgaacgugcaccucgcccccgccguggcgcccaccuuccccggcgagcagcugcuguucuuccgcuccacgaugccggggugcagcggcuaccccaacauggaccucgacugccugcugccccaggaguggguccaguacuucuaccaggaggccgcccccgcccaguccgacguggcgcuccugcgguucgugaacccggacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccgggcccucuga

SEQ ID NO: 9794 - RNA, 1623 nt, Artificial Sequence; identical to SEQ ID NO: 9764
  derived and/or modified sequence opt1 from VP1__Norovirus__AJA71460

SEQ ID NO: 9795 - RNA, 1623 nt, Artificial Sequence; identical to SEQ ID NO: 9493
  derived and/or modified sequence opt1 from VP1__Norovirus__AJA71461

SEQ ID NO: 9796 - RNA, 1623 nt, Artificial Sequence; identical to SEQ ID NO: 9767
  derived and/or modified sequence opt1 from VP1__Norovirus__AJA71462

SEQ ID NO: 9797 - RNA, 1623 nt, Artificial Sequence; identical to SEQ ID NO: 9777
  derived and/or modified sequence opt1 from VP1__Norovirus__AJA71463

SEQ ID NO: 9798 - RNA, 1623 nt, Artificial Sequence; identical to SEQ ID NO: 9771
  derived and/or modified sequence opt1 from VP1__Norovirus__AJA71464

SEQ ID NO: 9799 - RNA, 1623 nt, Artificial Sequence; identical to SEQ ID NO: 9771
  derived and/or modified sequence opt1 from VP1__Norovirus__AJA71465

SEQ ID NO: 9800 - RNA, 1623 nt, Artificial Sequence
  derived and/or modified sequence opt1 from VP1__Norovirus__AJA71466
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaaccugguccaggcccccgggggcgaguucaccgugagcccccggaacgcgcccggggagauccugugguccgcgccccucggcccggagcugaaccccuaccugagccaccucgcccgcauguacaacggcuacgccgggggcuucgaggugcaggucauccuggccgggaacgccuucaccgccggcaaggugaucuucgccgccgugccgcccaacuucccgacggaggggcugucccccagccaggucaccauguucccccacaucgugguggacguccggcagcucgagcccgugcugaucccgcugcccgacgugcgcaacaacuucuaccacuacaaccaguccaacgaccccaccaucaagcucaucgccaugcuguacacgccccugcgggcgaacaacgccggcgacgacgucuucaccgugagcugccgcgugcucacccggccgucccccgacuucgacuucaucuuccuggucccgcccaccguggagagccgcaccaagcccuucuccgugcccguccugacgguggaggagaugaccaacagccgguuccccaucccccucgagaagcuguucaccggcccguccagcgccuucgucgugcagccccagaacgggcgcugcaccacggacggcgugcugcucgggaccacccagcugucccccgucaacaucugcaccuuccggggcgacgugacgcacaucaccggcagccgcaacuacaccaugaaccuggccucccagaacuggagcaacuacgacccgaccgaggagauccccgcgccccucgggacgcccgacuucgugggcaagauccaggggguccugacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcuccccuccuacagcgggcgcaacaccccgaacguccaccuggcccccgcgguggcccccaccuuccccggcgagcagcuccuguucuuccgguccacgaugccggggugcagcggcuaccccaacauggaccuggacugccugcucccccaggagugggugcaguacuucuaccaggaggccgcccccgcgcaguccgacgucgcccugcugcgcuucgugaacccggacaccggccggguccucuucgagugcaagcugcacaagagcggguacgugaccguggcccacaccggccagcacgaccuggugaucccgcccaacggguacuuccgcuucgacuccugggucaaccaguucuacacccucgcccccaugggcaacgggacgggccgccggcgcgcccuguga

SEQ ID NO: 9801 - RNA, 1623 nt, Artificial Sequence
  derived and/or modified sequence opt1 from VP1__Norovirus__AJA71467
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacacccgcuucacccccgucggggugauccaggacggcgggacgacccaccggaacgagccccagcagugggugcugcccuccuacagcggccgcaacaccccgaacguccaccucgcccccgcgguggcccccaccuuccccggggagcagcugcuguucuuccgguccacgaugccgggcugcagcggcuaccccaacauggaccucgacugccugcugccccaggagugggugcagcacuucuaccaggaggccgcccccgcgcaguccgacgucgcccuccugcgcuucgugaacccggacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccgccggcgcgcccucuga

SEQ ID NO: 9802 - RNA, 1623 nt, Artificial Sequence
  derived and/or modified sequence opt1 from VP1__Norovirus__AJA71470
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccauccugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggagcaacuacgacccgaccgaggagauccccgcgccccuggggauccccgacuucgugggcaagauccaggggaugcucacgcagaccacccggaccgacggcagcacgcgcgggcacaaggccaccguguacaccggcuccgccgacuucgccccgaagcugggccggguccaguucgagaccgacacggaccacgacuucgaggccaaccagaacaccaaguucacccccgugggggugauccaggacggcagcaccacgcaccgcaacgagccccagcaguggguccugcccuccuacagcgggcggaacaccccgaacgugcaccucgcccccgcgguggcccccaccuuccccggcgagcagcugcuguucuuccgcuccaccaugccggggugcagcggcuaccccaacauggaccucgacugccugcugccccaggaguggguccaguacuucuaccaggaggccgcccccgcgcaguccgacguggcccuccugcgguucgugaacccggacacgggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggaccggccgccgccgggcccucuga

SEQ ID NO: 9803 - RNA, 1623 nt, Artificial Sequence
  derived and/or modified sequence opt1 from VP1__Norovirus__AJA71471
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggagcucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcugcccuccuacagcgggcgcaacaccccgaacguccaccucgcccccgcgguggcccccaccuuccccggcgagcagcugcuguucuuccgguccacgaugccggggugcagcggcuaccccaaccgcgaccucgacugccugcugccccaggagugggugcaguacuucuaccaggaggccgcccccgcgcaguccgacgucgcccuccugcgguucgugaacccggacaccggccgcgugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggacgggccggcgccgggcccucuga

SEQ ID NO: 9804 - RNA, 1623 nt, Artificial Sequence
  derived and/or modified sequence opt1 from VP1__Norovirus__AJA71472
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggagcucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcugcccuccuacagcgggcgcaacaccccgaacguccaccucgcccccgcgguggcccccaccuuccccggcgagcagcugcuguucuuccgguccacgaugccggggugcagcggcuaccccaacauggaccucgacugccugcugccccaggagugggugcaguacuucuaccaggaggccgcccccgcgcaguccgacgucgcccuccugcgcuucgugaacccggacaccggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggacgggccgccggcgcgcccucuga

SEQ ID NO: 9805 - RNA, 1623 nt, Artificial Sequence
  derived and/or modified sequence opt1 from VP1__Norovirus__AJA71473
augaagauggccagcuccgacgccagccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccgcgacuucgaggccaaccagaacaccaaguucacccccgucggggugauccaggacggcgggacgacccaccggaacgagccccagcagugggugcugcccuccuacagcggccgcaacaccccgaacguccaccucgcccccgcgguggcccccaccuuccccggggagcagcugcuguucuuccgguccacgaugccgggcugcagcggcuaccccaacauggaccucgacugccugcugccccaggagugggugcaguacuucuaccaggaggccgcccccgcgcaguccgacgucgcccuccugcgcuucgugaacccggacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccgccggcgcgcccucuga

SEQ ID NO: 9806 - RNA, 1623 nt, Artificial Sequence
  derived and/or modified sequence opt1 from VP1__Norovirus__AJA71474
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcgggacgacccaccggaacgagccccagcagugggugcugcccagcuacuccggccgcaacaccccgaacguccaccucgcccccgcgguggcccccaccuuccccggggagcagcugcuguucuuccggagcacgaugccgggcugcuccggcuaccccaacaccgaccucgacugccugcugccccaggagugggugcaguacuucuaccaggaggccgcccccgcgcagagcgacgucgcccuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacgcuggcccccauggggaacggcaccggccgccggcgcgcccucuga

SEQ ID NO: 9807 - RNA, 1623 nt, Artificial Sequence; identical to SEQ ID NO: 9688
  derived and/or modified sequence opt1 from VP1__Norovirus__AJA71475

SEQ ID NO: 9808 - RNA, 1623 nt, Artificial Sequence; identical to SEQ ID NO: 9767
  derived and/or modified sequence opt1 from VP1__Norovirus__AJA71476

SEQ ID NO: 9809 - RNA, 1623 nt, Artificial Sequence
  derived and/or modified sequence opt1 from VP1__Norovirus__AJF21974
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcgggucauccucgccgggaacgccuucaccgccggcaaggugaucuucgccgccgugccgcccaacuucccgacggaggggcugucccccagccaggucaccauguucccccacaucgugguggacguccgccagcuggagcccgugcucaucccgcugcccgacgugcggaacaacuucuaccacuacaaccaguccaacgaccccaccaucaagcugaucgccaugcucuacacgccccugcgcgcgaacaacgccggcgacgacgucuucaccgugagcugccgggugcugacccgcccgucccccgacuucgacuucaucuuccucgucccgcccaccguggagagccggaccaagcccuucuccgugcccauccugacggucgaggagaugaccaacagccgcuuccccaucccccuggagaagcuguucaccggcccguccagcgccuucgugguccagccccagaacgggcggugcaccacggacggcgugcuccuggggaccacccagcucucccccgugaacaucugcaccuuccgcggcgacgucacgcacaucaccggcagccggaacuacaccaugaaccuggccucccagaacuggagcaacuacgacccgaccgaggagauccccgcgccccuggggauccccgacuucgugggcaagauccaggggaugcucacgcagaccacccgcaccgacggcagcacgcgggggcacaaggccaccguguacaccggcuccgccgacuucgccccgaagcugggccgcguccaguucgagaccgacacggaccacgacuucgaggccaaccagaacaccaaguucacccccgugggggugauccaggacggcagcaccacgcaccggaacgagccccagcaguggguccugcccuccuacagcgggcgcaacaccccgaacgugcaccucgcccccgcgguggcccccaccuuccccggcgagcagcugcuguucuuccgguccaccaugccggggugcagcggcuaccccaacauggaccucgacugccugcugccccaggaguggguccaguacuucuaccaggaggccgcccccgcgcaguccgacguggcccuccugcgcuucgugaacccggacacgggccggguccuguucgagugcaagcuccacaagagcggguacgugaccguggcccacaccggccagcacgaccuggucaucccgcccaacggguacuuccgcuucgacuccugggugaaccaguucuacacccuggcccccaugggcaacgggaccggccgccggcgcgcccucuga

SEQ ID NO: 9810 - RNA, 1623 nt, Artificial Sequence
  derived and/or modified sequence opt1 from VP1__Norovirus__AJF21975
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccaacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgggcccucuga

SEQ ID NO: 9811 - RNA, 1623 nt, Artificial Sequence; identical to SEQ ID NO: 9742
  derived and/or modified sequence opt1 from VP1__Norovirus__AJF21976

SEQ ID NO: 9812 - RNA, 1623 nt, Artificial Sequence
  derived and/or modified sequence opt1 from VP1__Norovirus__AJF21977
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcacggacggcagcacccgggggcacaaggccaccguguacaccggcuccgccgacuucgccccgaagcugggccgcgugcaguucgagacggacaccaaccacgacuucgaggccaaccagaacaccaaguucacccccgucggggugauccaggacggcagcacgacccaccggaacgagccccagcagugggugcugcccuccuacagcgggcgcaacaccccgaacguccaccucgcccccgcgguggcccccaccuuccccggcgagcagcugcuguucuuccgguccacgaugccggggugcagcggcuaccccaacauggaccucgacugccugcugccccaggagugggugcaguacuucuaccaggaggccgcccccgcgcaguccgacgucgcccuccugcgcuucgugaacccggacaccggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggacgggccggcgccgcgcccucuga

SEQ ID NO: 9813 - RNA, 1623 nt, Artificial Sequence
  derived and/or modified sequence opt1 from VP1__Norovirus__AJF21978
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgagaccaaccagaacaccaaguucacgcccgucggggugauccaggacggcgggaccacccaccgcaacgagccccagcagugggugcugcccagcuacuccggccggaacaccccgaacguccaccucgcccccgccguggcgcccacguuccccggggagcagcugcuguucuuccgcagcaccaugccgggcugcuccggcuaccccaacaccgaccucgacugccugcugccccaggagugggugcaguacuucuaccaggaggccgcccccgcccagagcgacgucgcgcuccugcgguucgugaacccggacaccgggcgcgugcuguucgagugcaagcuccacaaguccggcuacgucaccguggcccacacggggcagcacgaccuggugaucccgcccaacggcuacuuccgguucgacagcugggucaaccaguucuacacccuggcccccauggggaacggcaccggccgccgccgggcccucuga

SEQ ID NO: 9814 - RNA, 1623 nt, Artificial Sequence
  derived and/or modified sequence opt1 from VP1__Norovirus__AJF21979
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcacggacggcagcacccgggggcacaaggccaccguguacaccggcuccgccgacuucgccccgaagcugggccgcgugcaguucgagacggacaccaaccacgacuucgaggccaaccagaacaccaaguucacccccgucggggugauccaggacggcgggacgacccaccggaacgagccccagcagugggugcugcccagcuacuccggccgcaacaccccgaacguccaccucgcccccgcgguggcccccaccuuccccggggagcagcugcuguucuuccggagcacgaugccgggcugcuccggcuaccccaacauggaccucgacugccugcugccccaggagugggugcaguacuucuaccaggaggccgcccccgcgcagagcgacgucgcccuccugcgcuucgugaacccggacaccgggcgggugcuguucgagugcaagcuccacaaguccggcuacgucaccguggcccacaccgggcagcacgaccuggugaucccgcccaacggcuacuuccgcuucgacagcugggucaaccaguucuacacccuggcccccauggggaacggcacgggccggcgccgcgcccucuga

SEQ ID NO: 9815 - RNA, 1623 nt, Artificial Sequence
  derived and/or modified sequence opt1 from VP1__Norovirus__AJF21980
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggaugcucacccagaccacccggacggacggcagcacccgcgggcacaaggccaccgucuacaccggcagcgccgacuucgccccgaagcugggccgggugcaguucgagacggacaccgaccacgacuucgaggccaaccagaacaccaaguucacccccgugggggucauccaggacggcuccacgacccaccgcaacgagccccagcagugggugcugcccagcuacuccgggcggaacacccacaacgugcaccucgccccggcggucgcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacguggcccuccugcgguucgucaaccccgacaccggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggacgggccgccgccgggucguguga

SEQ ID NO: 9816 - RNA, 1623 nt, Artificial Sequence; identical to SEQ ID NO: 9802
  derived and/or modified sequence opt1 from VP1__Norovirus__AJF21981

SEQ ID NO: 9817 - RNA, 1623 nt, Artificial Sequence; identical to SEQ ID NO: 9771
  derived and/or modified sequence opt1 from VP1__Norovirus__AJF21982

SEQ ID NO: 9818 - RNA, 1623 nt, Artificial Sequence
  derived and/or modified sequence opt1 from VP1__Norovirus__AJF21983
augaagauggccagcuccgacgccaaccccagcgacggcuccgcggccagccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucagcccgaagcugggccgggugcaguucgagacggacaccgaccgcgacuucgaggccaaccagaacaccaaguucacccccgucggggugauccaggacggcgggacgacccaccggaacgagccccagcagugggugcugcccuccuacagcggccgcaacgccccgaacguccaccucgcccccgcgguggcccccaccuuccccggggagcagcugcuguucuuccgguccaccaugccgggcugcagcggcuaccccaacauggaccucgacugccugcugccccaggagugggugcaguacuucuaccaggaggccgcccccgcgcaguccgacgucgcccuccugcgcuucgugaacccggacacggggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcaccggccgccggcgcgcccucuga

SEQ ID NO: 9819 - RNA, 1623 nt, Artificial Sequence
  derived and/or modified sequence opt1 from VP1__Norovirus__AJF21984
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcgccgacggcagcacgcgggggcacaaggccaccguguacaccggcuccgccgacuucgccccgaagcugggccgcgugcaguucgagaccgacacgaaccacgacuucgaggccaaccagaacaccaaguucacccccgucggggugauccaggacggcgggaccacgcaccggaacgagccccagcagugggugcugcccagcuacuccggccgcaacaccccgaacguccaccucgcgcccgccguggcccccaccuuccccggggagcagcugcuguucuuccggagcaccaugccgggcugcuccggcuaccccaacauggaccucgacugccugcugccccaggagugggugcaguacuucuaccaggaggccgcgcccgcccagagcgacgucgcccuccugcgcuucgugaacccggacacggggcgggugcuguucgagugcaagcuccacaaguccggcuacgucaccguggcccacaccgggcagcacgaccuggugaucccgcccaacggcuacuuccgcuucgacagcugggucaaccaguucuacacccuggcccccauggggaacggcaccggccggcgccgcgcgcucuga

SEQ ID NO: 9820 - RNA, 1623 nt, Artificial Sequence
  derived and/or modified sequence opt1 from VP1__Norovirus__AKE37037
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccgucaaccuccgcaucagcgacaacgacgacuuccaguuccagcccaccaaguucacccccgugggggugaacgacgacgacgacggccaccccuuccggcagugggagcugccgaacuacuccggggagcugacccucaacaugaaccuggccccgcccgucgcccccaacuuccccggcgagcagcuccuguucuuccgcagcuucgugcccugcuccgggggcuacaaccagggcaucaucgacugccugaucccccaggaguggauccagcacuucuaccaggagagcgcccccucccagagcgacguggcccugauccgguacgucaacccggacacggggcgcacccucuucgaggcgaagcugcaccgcuccggcuacaucaccguggcccacagcggggacuacccccuggugguccccgccaacggccacuuccgguucgacuccugggugaaccaguucuacagccucgcccccauggggaccggcaacggccgccggcgcgcgcaguga

SEQ ID NO: 9821 - RNA, 1632 nt, Artificial Sequence
  derived and/or modified sequence opt1 from VP1__Norovirus__AKM20815
augaugauggccagcaaggacgcccccaccaacauggacggcaccuccggggcgggccagcuggugccggaggccaacacggccgagccccuccccaucaagcccgucgccggggccgcgaccgccguggccaccgccggccaggugaacaugaucgacccguggaucaugaacaacuucguccaggcgccccagggggaguucaccaucagccccaacaacacgcccggcgacauccuguucgaccugcagcucggcccgcaccugaaccccuuccuggcccaccucucccgcauguacaacgggugggugggcaacaugcagguccggaucaugcuggccgggaacgccuucagcgccggcaagaucaucgugugcugcaucccgcccggguucuccagccaguccaucagcaucgcgcaggccaccauguucccccacgugaucgccgacgugcgcguccuggagcccaucgacgugccccucgacgacgugcggaacguccuguuccacaacaacgacaacccccagaccaugcgccugcucugcaugcuguacaccccgcugcgguccggcggcacgagcuccgggaccgaccccuucgugaucgccggccgcgugcugaccugccccacccccgacuucagcuuccucuuccuggucccgcccgacaucgagcagcggacgaagcccuucuccgugcccaacaucccgaugaaccucaugagcaacucccgcgugagcaugcugaucgacgggaugauggucuccaacgaccagaaccaggugccccaguuccagaacggccgggugacccuggacggccagcuccaggggaccaccacggucagcgccgcgugcguggcccgcaugcggggccgcaucuucaacaacaacgggaacuacggcgugaaccugaccgagcuggacgggaaccccuaccacgccuucgacucccccgccccgcucggcuuccccgacuucggcaacugcgaccugcacaugaccuucgucaagaucaaccccaacgagcugagcagcggggacccguccggcaagguggucauccggagcuacgacgccaccuucgcgccccaccucgggacggugaagcuggagaacgacgacgagcuggcccgcuucgugggcaaggaggucgugcucgagcugaccuggguguccaaccgggagggggccacccugaaccucugggccguccccaacuacggcagcucccugacccaggccagccagcuggcgcccccgaucuacccgcccggcuucggggaggccaucguguacuucacguccaccuuccccaccgugagcaaccccaagguccccugcacccucccccaggaguucgugucccacuucgugaacgagcaggcccccacgcgcggcgacgccgcgcugcugcacuacgucgacccggacacccaccggaaccucggggaguucaagauguaccccgagggcuacaugaccugcgugcccaacgccgggggcggcccccagacccugccgaucaacgggguguucgucuucaucagcugggugucccgcuacuaccagcugaagcccgugggcacggccggggccgcccggcgccucggccugcggcgcagcuga

SEQ ID NO: 9822 - RNA, 1623 nt, Artificial Sequence
  derived and/or modified sequence opt1 from vp1__Norovirus__AKM20818
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgauccagggcauguucaugucccccgacgucaaccagagcgugcaguuccagaacgggcgcugccagaucgacggccagcugcaggggaccacccccgugucccucagccagcugugcaagauccggggcaagacguccagcaacgcccgcguccugaaccucagcgagguggacgggacccccuucaucccgcuggagucccccgcccccgucggcuucccggaccugggcgggugcgacuggcacgugaacuucagcuuccagacccaggaccgggaccccucccagagcgugaccuucgcgacgaacgacgccuccuucguccccuaccucggcagcgugagcccccacaacggggagggcuuccaggccggggacaucaucggcucccugggcuggaucuccgccccgagcgacaacucccaguucaacgugugggccauccccaaguacgggagcucccugcccgacgucacccaccucgcgcccgccguguucccgcccggcuucggggaggugauccuguacuucuacagcaccuuccccggcuccgggcagcccagccagcugcaggucccgugccuccugccccaggaguucaucacccacuucugcaacgagcaggcccccaucgccggcgaggcggcccugcuccacuacguggaccccgacacgggccgcaaccugggggaguucaagcuguacccggacggcuucaugaccugcgugcccaacuccgucagcuccgggccccagacccuccccaucaacggcguguucguguucgucagcugggugagccgguucuaccagcugaagccggugggcaccgccuccgccgcccgccggcuggggcuccgccggaucuga

SEQ ID NO: 9823 - RNA, 1623 nt, Artificial Sequence
  derived and/or modified sequence opt1 from VP1__Norovirus__ALD83748
augaagauggccagcaacgacgccgcgcccuccaacgacggcgccaccgggcuggugccggaggucaacaacgagacccucccccuggagcccguggccggcgccgccaucgcggcccccgugacggggcagaacaacaucaucgacccguggauccgcaccaacuucguccaggcccccaacggcgaguucaccgugagcccccggaacucccccggggagauccugcucaaccuggagcugggcccggaccucaaccccuaccuggcccaccugagccgcauguacaacggcuacgccgggggcguggagguccaggugcuccuggccgggaacgccuucaccgccggcaagauccuguucgccgcggugccgcccaacuuccccgucgaguuccucucccccgcccagaucacgaugcugccccaccugaucguggacgugcggacccucgagcccaucaugaucccgcugcccgacguccgcaacaccuucuuccacuacaacaaccagcccaccaaccggaugcgccugguggccaugcucuacacgccccugcggagcaacggguccggcgacgacguguucaccgucagcugccgcgugcugacccggccgacccccgacuucgaguucacguaccucgugccgcccuccgucgagagcaagaccaagcccuucucccugcccauccugaccaucagcgagcucaccaacucccgcuuccccgugcccguggacagccuguucacggcccagaacaacaaccugaacguccagugccagaacggccggugcacccucgacggggagcugcagggcaccacccagcugcagccguccgggaucugcgccuuccgcggcaagaucacggcggacgugcggcccaaccacgacgaccgcuggcacaugcagcucaccaaccugaacggcacccccuucgacccgaccgaggacgugcccgcgccccuggggacgcccgacuucaccggccuccuguucggggucgccagccagcggaacgugcagccgaaccccaacaccacccgcgcccacgaggccgucaucuccacgaccagcucccaguucgugcccaagcugggcagcaucaacuucgggagcaccuccgaggacuucaucgugggccagcccaccaaguucacgccggucggcaucaagaucgaggacgggcacgcguucgaccaguggacccucccccgguacagcggccaccugacccugaacaugaaccucgccccgcccguggcccccaacuuccccggggagcagcugcuguucuuccgcuccaacgugcccugcgccggcgggaucagcgacggcgucaucgacugccuccugccccaggaguggauccagcacuucuaccaggaguccgccccgagccaguccgacguggcgcugauccgguacgugaaccccgacaccggccgcacccucuucgaggccaagcugcaccggacgggguacaucaccgucgcccacagcggcgacuacccccugguggugcccuccaacggguacuuccgcuucgacagcugggucaaccaguucuacucccucgccccgaugggcaccgggaacggccgccggcgcgugcaguga

SEQ ID NO: 9824 - RNA, 1623 nt, Artificial Sequence
  derived and/or modified sequence opt1 from VP1__Norovirus__ALF12528
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcacguucgugguccagccccagaacgggcgcugcaccaccgacggcgugcuccuggggaccacgcagcucucccccgucaacaucugcaccuuccggggcgacgugacccacaucgccggcagccacaacuacaccaugaaccuggccucccagaacuggaacagcuacgacccgacggaggagauccccgcgccccuggggacccccgacuucgugggcaagauccaggggguccucacccagaccacgcgcaccgacggcagcacccgggggcacaaggccaccguguacacgggcuccgccgacagcuccccgaagcugggccgcgugcaguucgccaccgacaccgacaacgacuucgucgccaaccagaacaccaaguucacgcccgugggggugauccaggacggcgggaccgcccaccggaacgagccccagcaguggguccugcccagcuacuccggccgcaacacccacaacgugcaccucgccccggcgguggcccccaccuuccccggggagcagcugcuguucuuccggagcacgaugcccggcugcuccggcuacccgaacauggaccucgacugccugcugccccaggaguggguccaguacuucuaccaggaggccgcccccgcgcagagcgacguggcccuccugcgcuucgugaaccccgacaccgggcggguccuguucgagugcaagcuccacaaguccggcuacgugacccaggcccacaccgggcagcacgaccuggugaucccgcccaacggcuacuuccgcuucgacagcugggucaaccaguucuacacccuggcccccauggggaacggcacgggccggcgccgcgcccucuga

SEQ ID NO: 9825 - RNA, 1623 nt, Artificial Sequence
  derived and/or modified sequence opt1 from VP1__Norovirus__ALF12529
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucguguucuccgccgugccgcccaacuucccgacggaggggcugagccccucccaggucaccauguucccccacaucaucguggacgugcggcagcuggagcccguccucaucccgcugcccgacgugcgcaacaacuucuaccacuacaaccagagcaacgaccccaccaucaagcugaucgccaugcucuacacgccccugcgggccaacaacgcgggcgacgacguguucaccgucuccugccgcgugcugacccggccgagccccgacuucgacuucaucuuccucgugccgcccaccgucgagucccgcaccaagcccuucagcgugcccauccugacgguggaggagaugaccaacucccgguuccccaucccccuggagaagcuguucaccggcccgagcuccaccuucgucgugcagccccagaacgggcgcugcacgaccgacggcguccuccuggggaccacccagcucagccccgugaacaucugcacguuccggggcgacgugacccacaucgccggcucccgcaacuacaccaugaaccuggccagccagaacuggaacagcuacgacccgaccgaggagauccccgcgccccuggggacgcccgacuucgucggcaagauccagggggugcucacccagaccacccggacggacggcuccacccgcgggcacaaggccaccguguacaccggcagcgccgacuucuccccgaagcugggccggguccaguucgccacggacaccgacaacgacuucgacgccaaccagaacaccaaguucacccccgugggggugauccaggacggcaacacggcccaccgcaacgagccccagcaguggguccugcccagcuacuccgggcggaacacccacaacgugcaccucgccccggcgguggcccccaccuuccccggcgagcagcugcuguucuuccgcagcaccaugcccgggugcuccggcuacccgaacauggaccucgacugccugcugccccaggaguggguccaguacuucuaccaggaggccgcccccgcgcagagcgacguggcccuccugcgguucgugaaccccgacacgggccgcguccuguucgagugcaagcuccacaaguccggguacgugaccguggcccacaccggccagcacgaccuggucaucccgcccaacggguacuuccgguucgacagcugggugaaccacuucuacacccuggcccccgugggcaacgggaccggccgccgccgggcccucuga

SEQ ID NO: 9826 - RNA, 1623 nt, Artificial Sequence
  derived and/or modified sequence opt1 from VP1__Norovirus__ALF12530
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcagccacaacuacaccaugaaccuggccucccagaacuggaacagcuacgacccgaccgaggagauccccgcgccccuggggacgcccgacuucgugggcaagauccaggggguccucacccagaccacccgcgccgacggcagcacgcgggggcacaaggccaccguguacaccggcuccgccgacuucagcccgaagcugggccgcgugcaguucgccaccgacacgaacaacgacuucgacgccaaccagaacaccaaguucacccccgucggggugauccaggacggcgagaccgcgcaccggaacgagccccagcagugggugcugcccuccuacagcgggcgcaacauccacaacguccaccucgccccggccguggcccccacguuccccggcgagcagcugcuguucuuccgguccaccaugcccgggugcagcggcuacccgaacauggagcucgacugccugaucccccaggagugggugcaguacuucuaccaggaggcggcccccgcccaguccgacgucgcccugcuccgcuucgugaaccccgacaccggccgggugcuguucgagugcaagcugcacaagagcggguacgucaccguggcccacacgggccagcacgaccucgugaucccgcccaacggguacuuccgcuucgacuccugggucaaccaguucuacacccuggcgcccaugggcaacgggaccggccggcgccgcgcccuguga

SEQ ID NO: 9827 - RNA, 1623 nt, Artificial Sequence
  derived and/or modified sequence opt1 from VP1__Norovirus__ALF12531
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucgccggcucccgcaacuacaccaugaaccuggccagccagaacuggaacagcuacgaccccaccgaggagaucccggcgccccuggagacgcccgacuucguggggaagauccagggcguccucacccagaccacccggacggacggguccacccgcggccacaaggccaccguguacaccgggagcgccgacuucucccccaagcugggccgggugcaguucgccacggacaccgacaacgacuucgacagcaaccagaacaccaaguucaccccggucggcgugauccaggacgggggcacgacccaccgcaacgagccccagcagugggugcugcccuccuacagcgggcgggacauccacaacguccaccucgcccccgccguggcgccgaccuuccccggcgagcagcugcuguucuuccgcuccaccaugcccgggugcagcggcuaccccaacauggaccucgacugccugcugccgcaggagugggugcaguacuucuaccaggaggccgcccccgcccaguccgacgucgcgcuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgggugcucuga

SEQ ID NO: 9828 - RNA, 1623 nt, Artificial Sequence
  derived and/or modified sequence opt1 from VP1__Norovirus__ALF12532
augaagauggccagcuccgacgccaaccccagcgacggcuccaccgcgaaccuggugccggaggucaacaacgaggugauggcccucgagcccguggucggggccgccaucgccgcgcccguggccggccagcagaacgccaucgaccccuggauccgcaacaacuucgugcaggcccccgggggcgaguucaccgucagcccccggaacgcgcccggggagauccugugguccgcgccccugggcccggaccucaaccccuaccugagccaccuggcccgcauguacaacggcuacgccgggggcuucgagguccaggugauccucgccgggaacgccuucacggccggcaagaucaucuucgccgccgugccgcccaacuucccgaccgaggggcugucccccagccaggugaccauguucccccacaucaucguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcacgaagcccuucagcgugcccauccugaccgucgaggagaugaccaacucccgguuccccaucccccuggagaagcuguucaccggccccagcuccgccuucguggugcagccgcagaacgggcgcugcacgaccgacggcguccuccuggggaccacccagcucagccccgugaacaucugcacguuccggggcgacgucacccacaucgccggcucccgcaacuacaccaugaaccuggccagccagaacuggaacagcuacgaccccaccgaggagaucccggcgccccuggggacgcccgacuucgugggcaagauccagggggugcucacccagaccacccggacggacggcuccacccgcgggcacaaggccaccgucuacaccggcagcgccgacuucucccccaagcugggccgggugcaguucgccacggacaccgacaacgacuucgacgccaaccagaacaccaaguucaccccggugggggucauccaggacggcgggacgacccaccgcaacgagccccagcagugggugcugcccagcuacuccggccggaacauccacaacgugcaccucgcgcccgccgucgccccgaccuuccccggggagcagcugcuguucuuccgcagcaccaugcccggcugcuccggcuaccccaacauggaccucgacugccugcugccgcaggagugggugcaguacuucuaccaggaggccgcgcccgcccagagcgacguggcccuccugcgguucgucaaccccgacacggggcgcgugcuguucgagugcaagcuccacaaguccggcuacgugaccgucgcccacaccgggcagcacgaccuggugaucccgcccaacggcuacuuccgguucgacagcugggugaaccaguucuacacccuggcccccauggggaacggcaccggccgccgccgggcgcucuga

SEQ ID NO: 9829 - RNA, 1623 nt, Artificial Sequence
  derived and/or modified sequence opt1 from VP1__Norovirus__ALF12533
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaccuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcaccaagcccuucuccguccccauccugaccguggaggagaugaccaacagccgguuccccaucccccuggagaagcuguucacgggcccguccagcaccuucgugguccagccccagaacgggcgcugcaccaccgacggcgugcuccuggggacgacccagcucucccccgucaacaucugcaccuuccggggcgacgugacccacaucacgggcagccacaacuacaccaugaaccuggccucccagaacuggagcagcuacgacccgaccgaggagauccccgcgccccuggggacccccgacuucgugggcaagauccaggggguccucacgcagaccacccgcaccgacggcuccacgcgggggcacaaggccaccguguucaccggcagcgccgacuucuccccgaagcugggccgcgugcaguucgccaccgacacggacaacgacuucgucgccaaccagaacaccaaguucacccccgugggggugauccaggacggcgggaccgcccaccggaacgagccccagcaguggguccugcccagcuacuccggccgcaacauccacaacgugcaccucgccccggccguggcgcccacguuccccggggagcagcugcuguucuuccggagcaccaugcccggcugcuccggcuacccgaacauggaccucgacugccugcugccccaggaguggguccaguacuucuaccaggaggccgcccccgcccagagcgacguggcgcuccugcgcuucgugaaccccgacaccgggcggguccuguucgagugcaagcuccacaaguccggcuacgugaccguggcccacaccgggcagcacgaccuggucaucccgcccaacggcuacuuccgcuucgacagcugggugaaccaguucuacacgcuggcccccauggggaacggcaccggccggcgccgcgcccucuga

SEQ ID NO: 9830 - RNA, 1623 nt, Artificial Sequence
  derived and/or modified sequence opt1 from VP1__Norovirus__ALF12534
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuucagccuggcccccaugggcaacgggaccggccgccgccgggcccucuga

SEQ ID NO: 9831 - RNA, 1623 nt, Artificial Sequence
  derived and/or modified sequence opt1 from VP1__Norovirus__ALF12535
augaagauggccagcuccgacgccaaccccagcgugggcuccgcggccaaccugguccccgaggugaacaacgaggugauggcccucgagcccgucgugggggccgccaucgcggcccccguggccggccagcagaacgucaucgaccccuggauccgcaacaacuucgugcaggcccccgggggcgaguucaccgugagcccccggaacgcgcccggggagauccugugguccgcgccccugggcccggaccucaaccccuaccugagccaccuggcccgcauguacaacggcuacgccgggggcuucgagguccucgugauccuggccgggaacgccuucaccgccggcaagaucaucuucgccgccgugccgcccaacuucccgacggaggggcugucccccagccaggucaccauguucccccacaucaucguggacgugcggcagcucgagcccguccugaucccgcugcccgacgugcgcaacaacuucuaccacuacaaccaguccaacgaccccaccaucaagcucaucgccaugcuguacacgccccugcgggcgaacaacgccggcgacgacguguucaccgucagcugccgcgugcucacccggccgucccccgacuucgacuucaucuuccuggugccgcccaccgucgagagccgcaccaagcccuucuccgugcccauccugacgguggaggagaugaccaacagccgguuccccaucccccucgagaagcuguucaccggcccguccagcgccuucgucgugcagccccagaacgggcgcugcaccacggacggcguccugcucgggaccacccagcugucccccgugaacaucugcaccuuccggggcgacgugacgcacaccaccggcagccacaacuacaccaugaaccuggccacgcagaacuggaacuccuacgacccgaccgaggagauccccgcgccccucgggacccccgacuucgucggcaagauccagggggugcugacccagacgaccaagaccgacggcagcacccgcgggcacaaggccacgguguacaccggcagcgccgacuucgccccgaagcugggccggguccaguucgccaccgacaccgacaacgacuucgaggccaaccagaacacgaaguucacccccgugggggugauccaggacggcgggaccgcgcaccgcaacgagccccagcaguggguccuccccuccuacagcggccggaacacccacaacgugcaccuggccccggccguggcccccacguuccccggggagcagcuccuguucuuccgcuccaccaugcccggcugcagcggcuacccgaacauggaccuggacugccugcucccccaggaguggguccaguacuucuaccaggaggcggcccccgcccaguccgacguggcccugcugcgguucgugaaccccgacaccgggcgcguccucuucgagugcaagcugcacaagagcggcuacgugaccguggcccacaccgggccgcacgaccuggucaucccgcccaacggcuacuuccgguucgacuccugggugaaccaguucuacacgcucgcgcccauggggaacggcaccggccgccggcgcgcccuguga

SEQ ID NO: 9832 - RNA, 1623 nt, Artificial Sequence
  derived and/or modified sequence opt1 from VP1__Norovirus__ALF12536
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccauccugacgguggaggagaugaccaacagccgguuccccaucccccuggagaagcuguucaccggcccguccagcgccuucgugguccagccccagaacgggcgcugcaccacggacggcgugcuccuggggaccacccagcucucccccgucaacaucugcaccuuccggggcgacgugacgcacaccaccggcagccacaacuacaccaugaaccuggccacgcagaacugguccagcuacgacccgaccgaggagauccccgcgccccuggggacccccgacuucgugggcaagauccaggggguccucacccagacgaccaagaccgacggcagcacccgcgggcacaaggccacgguguacaccggcuccgccgacuucgccccgaagcugggccgggugcaguucgccaccgacaccgacaacgacuucgaggccaaccagaacacgaaguucacccccgucggggugauccaggacggcaacaccgcgcaccgcaacgagccccagcagugggugcugcccagcuacuccgggcggaacacccacaacguccaccucgccccggccguggcccccacguuccccggcgagcagcugcuguucuuccgcagcaccaugcccgggugcuccggcuacccgaacauggaccucgacugccugcugccccaggagugggugcaguacuucuaccaggaggcggcccccgcccagagcgacgucgcccuccugcgguucgugaaccccgacaccggccgcgugcuguucgagugcaagcuccacaaguccggguacgucaccguggcccacaccggcccgcacgaccuggugaucccgcccaacggguacuuccgguucgacagcugggucaaccaguucuacacgcuggcgcccaugggcaacgggaccggccgccggcgcgcccucuga

SEQ ID NO: 9833 - RNA, 1623 nt, Artificial Sequence
  derived and/or modified sequence opt1 from VP1__Norovirus__ALF12537
augaagauggccagcuccgacgccaaccccagcgacggcuccaccgcgaaccuggcccccgaggugaacaacgaggucauggcccucgagcccguggugggggccgccaucgcggcccccgucgccggccagaagaacgugaucgaccccuggauccgcaacaacuucgugcaggcccccgggggcgaguucaccgucagcccccggaacgcgcccggggagauccugugguccgcgccccugggcccggaccucaaccccuaccugagccaccuggcccgcauguacaacggcuacgccgggggcuucgagguccaggugauccucgccgggaacgccuucacggccggcaagaucaucuucgccgccgugccgcccaacuucccgaccgaggggcugucccccagccaggugaccauguucccccacaucaucguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcacgaagcccuucuccgcccccgugcugaccgucgaggagaugaccaacagccgguuccccaucccccuggagaagcuguucaccggcccguccagcgccuucguggugcagccccagaacgggcgcugcacgaccgacggcguccuccuggggaccacccagcucucccccgugaacaucugcacguuccggggcgacgucacccacaucagcggcucccgcaacuacaccaugaaccuggccagccagaacuggaacagcuacgacccgaccgaggagauccccgcgccccuggggacgcccgacuucgugggcaagauccagggggugcucacccagaccacccggacgaacggcuccacccgcgggcacaaggccaccgucuacaccggcagcgccgacuucuccccgaagcugggccgggugcaguucgccacggacaccgacaacgacuucgagaccaaccagaacaccaaguucacgcccgugggggucauccaggacggcagcaccacgccccgcaacgagccccagcagugggugcugccguccuacagcgggcggaacacccacaacgugcaccucgcccccgcggucgcccccaccuuccccggcgagcagcugcuguucuuccgcuccaccaugccggggugcagcggcuaccccaacauggaccucgacugccugcugccccaggagugggugcaguacuucuaccaggaggccgcccccgcgcaguccgacguggcccuccugcgguucgucaacccggacaccggccgcgugcuguucgagugcaagcuccacaagagcggguacgugaccgucgcccacaccggccagcgggaccuggugaucccgcccaacggguacuuccgcuucgacuccugggugaaccaguucuacagccuggcccccaugggcaacgggacgggccgccggcgcgcccucuga

SEQ ID NO: 9834 - RNA, 1623 nt, Artificial Sequence
  derived and/or modified sequence opt1 from VP1__Norovirus__ALF12538
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucuccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgcguucgugguccagccccagaacgggcgcugcagcacggacggcgugcuccuggggaccacccagcucucccccgucaacaucugcaccuuccggggcgacgugacgcacaucgccggcagccacaacuacaccaugaaccuggccagccagaacugguccagcuacgacccgaccgaggagauccccgcgccccuggggacccccgacuucgugggcaagauccaggggguccucacgcagaccacccgcuccgacggcagcacccgggggcacaaggccacgguguacaccggcuccgccgacuucagcccgaagcugggccgcgugcaguucgccaccgacaccgacaacgacuucgucuccaaccagaacacgaaguucacccccgugggggugauccaggacggcgacaccgcccaccggaacgagccccagcaguggguccugcccagcuacuccgggcgcaacauccacaacgugcaccucgccccggccguggcgcccaccuuccccggcgagcagcugcuguucuuccggagcacgauccccgggugcuccggcuacccgaacauggaccucgacugccugcugccccaggaguggguccaguacuucuaccaggaggccgcccccgcccagagcgacguggcgcuccugcgcuucgugaaccccgacaccggccggguccuguucgagugcaagcuccacaaguccggguacgugaccguggcccacaccggccagcacgaccuggucaucccgcccaacggguacuuccgcuucgacagcugggugaaccacuucuacacgcuggcccccaugggcaacgggaccggccggcgccgcgugcucuga

SEQ ID NO: 9835 - RNA, 1623 nt, Artificial Sequence
  derived and/or modified sequence opt1 from VP1__Norovirus__ALF12539
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccggaucaucgucgacgugcgccagcuggagcccgugcucaucccgcugcccgacguccggaacaacuucuaccacuacaaccaguccaacgaccccaccaucaagcugaucgccaugcucuacacgccccugcgcgccaacaacgcgggcgacgacguguucaccgugagcugccggguccugacccgcccgucccccgacuucgacuucaucuuccucgugccgcccaccguggagagccggacgaagcccuucuccguccccauccugaccguggaggagaugaccaacagccgcuuccccaucccccuggagaagcuguucaccggcccguccagcgccuucgugguccagccccagaacgggcggugcuccacggacggcgugcuccuggggaccacccagcucagccccgucaacaucugcaccuuccgcggcgacgugacgcacaucgccggcucccacaacuacaccaugaaccuggccagccagaacuggagcuccuacgacccgaccgaggagauccccgcgccccuggggacccccgacuucgugggcaagauccaggggguccucacgcagaccacccggaccgacggcagcacgcgcgggcacaaggccaccguguacaccggcuccgccgacuucagcccgaagcugggccgggugcaguucgccaccgacacgaacaacgacuucgaguccaaccagaacaccaaguucgcccccgucggggugauccaggacggcgggaccgcccaccgcaacgagccccagcagugggugcugcccagcuacuccggccggaacauccacaacguccaccucgcgccggccguggcccccaccuuccccggggagcagcugcuguucuuccgcagcacgauccccggcugcuccggcuacccgaacauggaccucgacugccugcugccccaggagugggugcaguacuucuaccaggaggccgcgcccgcccagagcgacgucgcccuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacgcuggcccccauggggaacggcaccggccgccgccgggcgcucuga

SEQ ID NO: 9836 - RNA, 1623 nt, Artificial Sequence
  derived and/or modified sequence opt1 from VP1__Norovirus__ALF12541
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucguggggaacgccuucacggccggcaagaucaucuucgcggccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccagcgacuccaccaucaagcugaucgccaugcucuacacgccccugcgggccaacaacgccggcgacgacguguucaccgucagcugccgcgugcugacccggcccuccccggacuucgacuucaucuuccucgugccgcccaccgucgagagccgcacgaagcccuucuccgugcccgugcugaccgucgaggagaugaccaacagccgguuccccaucccccuggagaagcuguucaccggccccuccagcgcguucgugguccagccgcagaacgggcgcugcacgaccgacggcgugcuccuggggaccacccagcucucccccgugaacaucugcacguuccggggcgacgucacccacaucagcggcagccacaacuacaccaugaaccuggccucccagaacuggaacagcuacgaccccaccgaggagaucccggcgccccuggggacgcccgacuucgugggcaagauccagggggugcucacccagaccacccgcacggacggcuccacccgggggcacaaggccaccgucuacaccggcagcacggacuucacccccaagcugggccgcgcccaguucgccaccgacaccgacaacgacuucgagacgaaccagaacaccaaguucaccccggugggggugauccaggacggcgggaccacgcaccggaacgagccccagcaguggguccugcccuccuacagcggccgcaacacccacaacgugcaccucgcccccgccguggccccgaccuuccccggggagcagcugcuguucuuccgguccaccaugcccggcugcagcggcuaccccaacauggaccucgacugccugcugccgcaggaguggguccaguacuucuaccaggaggccgcgcccgcccaguccgacguggcccuccugcgcuucgugaaccccgacaccgggcggguccuguucgagugcaagcuccacaagagcggcuacgugacgguggcccacaccgggcagcacgaccuggucaucccgcccaacggcuacuuccgcuucgacuccugggugaaccaguucuacacccuggcgcccauggggaacggcaccggccggcgccgcgcccucuga

SEQ ID NO: 9837 - RNA, 1623 nt, Artificial Sequence
  derived and/or modified sequence opt1 from VP1__Norovirus__ALF12542
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccugggggcccccgacuucgugggcaagauccaggggaugcucacgcagaccacccgggccgacggcagcacccgcgggcacaaggccacggucuacaccggcagcgccgacuucgccccgaagcugggccgggugcaguucgagaccgacaccgaccacgacuucgaggcgaaccagaacacgaaguucacccccgugggggucauccaggacggcuccaccacccaccgcaacgagccccagcagugggugcugcccagcuacuccgggcggaacacgcacaacgugcaccucgccccggccgucgcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacguggcccuccugcgguucgucaaccccgacaccggccgcgugcuguucgagugcaagcuccacaaguccggguacgugacggucgcccacaccggccagcacgaccuggugaucccgcccaacggguacuuccgguucgacagcugggugaaccaguucuacacccuggcgcccaugggcaacggggccggccgccgccgggcccucuga

SEQ ID NO: 9838 - RNA, 1623 nt, Artificial Sequence
  derived and/or modified sequence opt1 from VP1__Norovirus__ALF12543
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacugcgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcagcacgacccaccgcaacgagccccagcagugggugcugcccuccuacagcgggcggaacacccacaacguccaccucgcccccgcgguggccccgaccuuccccggcgagcagcugcuguucuuccgcuccacgaugcccgggugcagcggcuaccccaacauggaccucgacugccugcugccgcaggagugggugcaguacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccgccgggcccucuga

SEQ ID NO: 9839 - RNA, 1623 nt, Artificial Sequence
  derived and/or modified sequence opt1 from VP1__Norovirus__ALF12546
augaagauggccagcuccgacgccaaccccagcgagggcuccaccgcgagccuggugccggaggucaacaacgaggugauggcccucgagcccguggccggggccgccaucgcggcccccgucgccggccaggugaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgagcccaccaucaagcugguggccaugcucuacacgccccugcgggcgaacaacgccggcgacgacguguucaccgucuccugccgcgugcugacccggccgagccccgacuucgacuucaucuuccucgugccgcccaccgucgagucccgcacgaagcccuucagcgugcccauccugaccguggaggagaugaccaacucccgguuccccaucccccuggagaagcuguucaccggcccgagcuccagcuucgucgugcagccccagaacgggcgcugcacgaccgacggcguccuccuggggaccacccagcucucccccgugaacaucugcacguuccggggcgacgugacccacaucagcggcagccgcaaccacaccaugaaccuggccucccagaacuggaacagcuacgacccgaccgaggagauccccgcgccccuggggacgcccgacuucgucggcaagauccagggggugcucacccagaccacccgguccgacggcagcacgcgcgggcacaaggccaccguguacaccggcuccgccgacuucagcccgaagcugggccggauccaguucgccaccgacacggacaacgacuucgagaccaaccagaacaccaaguucacccccgucggggugauccaggacggcgggacgacccaccgcaacgagccccagcagugggugcugcccaccuacuccggccggaacacccacaacguccaccucgccccggccguggcccccacguuccccggggagcagcugcuguucuuccgcagcaccaugcccggcugcuccggcuacccggacauggaccucgacugccugcugccccaggagugggugcagcacuucuaccaggaggcggcccccgcccagagcgacgucgcccuccugcgguucgugaaccccgacaccgggcgcgugcuguucgagugcaagcuccacaaggcgggcuacgucaccguggcccacaccgggcagcacgaccuggugaucccgcccaacggcuacuuccgguucgacuccugggucaaccaguucuucacgcuggcccccauggggaacggcaccggccgccgccgggcccucuga

SEQ ID NO: 9840 - RNA, 1623 nt, Artificial Sequence
  derived and/or modified sequence opt1 from VP1__Norovirus__ALF12547
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucuccguccccgugcugacgguggaggagaugaccaacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcgacgugacgcacaucaccggcagccgcaacuacaccaugaaccuggccucccagaacuggaacaacuacgacccgaccgaggagauccccgcgccccuggggacgcccgacuucgucggcaagauccaggggaugcucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggagcgcccacaacguccaccucgcgccggccguggcccccaccuuccccggcgagcagcugcuguucuuccgcuccaccaugcccgggugcagcggcuacccgaacauggaccucgacugccugcugccccaggagugggugcaguacuucuaccaggaggccgcgcccgcccaguccgacgucgcccuccugcgguucgugaaccccgacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgggcgcucuga

SEQ ID NO: 9841 - RNA, 1623 nt, Artificial Sequence
  derived and/or modified sequence opt1 from VP1__Norovirus__ALF12560
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacuccgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcagcuuccggggcgacgugacgcacaucgccggcagccgcaacuacaccaugaaccuggccucccagaacuggaacagcuacgacccgaccgaggagauccccgcgccccuggggacccccgacuucgugggcaagauccaggggguccucacgcagaccacccggaccgacggcuccacgcgcgggcaccgggccaccguguacaccggcagcgccgacuucuccccgaagcugggccgcgugcaguucgccaccgacacggacaacgacuucgucgccaaccagaacaccaaguucacccccgugggggugauccaggacggcgacaccgcccaccggaacgagccccagcaguggguccugcccagcuacuccgggcgcaacauccacaacgugcaccucgcgccggccguggcccccacguuccccggcgagcagcugcuguucuuccggagcaccaugcccgggugcuccggcuacccgaacauggaccucgacugccugcugccccaggaguggguccagcacuucuaccaggaggccgcgcccgcccagagcgacguggcccuccugcgcuucgugaaccccgacaccggccggguccuguucgagugcaagcuccacaaguccggguacgugaccguggcccacacgggccagcacgaccuggucaucccgcccaacggguacuuccgcuucgacagcugggugaaccaguucuacacccuggcccccaugggcaacgggaccggccgccggcgcgcgcucuga

SEQ ID NO: 9842 - RNA, 1623 nt, Artificial Sequence
  derived and/or modified sequence opt1 from VP1__Norovirus__ALF12562
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccacgccccugggcccggaccucaaccccuaccugagccaccuggcgcgcauguacaacggcuacgccgggggcuucgaggugcaggucauccucgccgggaacgccuucaccgccggcaagaucaucuucgcggccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgccggcgacgacguguucaccgugagcugccgcguccugacccggccgucccccgacuucgacuucaucuuccucgugccgcccaccguggagagccgcaccaagcccuucuccguccccgugcugaccguggaggagaugaccaacagccgguuccccaucccccuggagaagcuguucacgggcccguccagcgcguucgucgugcagccccagaacgggcgcugcaccaccgacggcguccuccuggggaccacgcagcucucccccgugaacaucugcaccuuccggggcgacgugacccacaucagcggcucccgcaacuacaccaugaaccuggccagccagaacuggaacagcuacgacccgacggaggagauccccgcgccccuggggacccccgacuucgucggcaagauccagggggugcucacccagaccacgcggaccgacggcuccacccgcgggcacaaggccaccguguacacgggcagcgccgacuucuccccgaagcugggccggguccaguucgccaccgacaccgacaacgacuucgagaccaaccagaacacgaaguucacccccgugggggugauccaggacggcagcaccacccaccgcaacgagccccagcaguggguccugcccuccuacagcgggcggaacacgcacaacgugcaccucgccccggccguggcccccaccuuccccggcgagcagcugcuguucuuccgcuccaccaugcccgggugcagcggcuacccgaacauggaccucgacugccugcugccccaggaguggguccaguacuucuaccaggaggccgcgcccgcccaguccgacguggcccuccugcgguucgugaaccccgacaccggccgcguccuguucgagugcaagcuccacaagagcggguacgugaccguggcccacacgggccagcacgaccuggucaucccgcccaacggguacuuccgguucgacuccugggugaaccaguucuacacccuggcgcccaugggcaacgggaccggccgccgccgggcccucuga

SEQ ID NO: 9843 - RNA, 1623 nt, Artificial Sequence
  derived and/or modified sequence opt1 from VP1__Norovirus__ALF12564
augaagauggccagcuccgacgccaacagcuccgacggcagcgcggccaaccuggugcccgaggucaacaacgaggugauggcccucgagccgguggucggggccgccaucgcggcccccguggccggccagcagaacgugaucgaccccuggauccgcaacaacuucguccaggcccccgggggcgaguucaccguguccccgcggaacgcgcccggggagauccuguggagcgcgccccugggccccgaccucaacccguaccugucccaccuggcccgcauguacaacggcuacgccgggggcuucgaggugcaggucauccucgccgggaacgccuucaccgccggcaagaucaucuucgccgccgugccgcccaacuuccccacggaggggcugagccccucccaggugaccauguucccccacaucaucgucgacgugcggcagcuggagcccgugcucaucccccugccggacguccgcaacaacuucuaccacuacaaccagagcaacgaccccaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccauccugacgguggaggagaugaccaacucccgguuccccaucccccuggagaagcuguucaccggccccagcuccgccuucgugguccagccgcagaacgggcgcugcaccacggacggcgugcuccuggggaccacccagcucagccccgucaacaucugcaccuuccggggcgacgugacgcacaucaccggcucccgcaacuacaccaugaaccuggccacccagaacuggaacagcuacgaccccacggaggagaucccggcgccccuggggacccccgacuucgugggcaagauccaggggguccucacccagaccacgaagaccgacggcagcacccgggggcacaaggccaccguguacacgggcuccgccgacuucgcccccaagcugggccgcgugcaguucgccaccgacaccgacaacgacuucgaggccaaccagaacaccaaguucacgccggucggggugauccaggacggcgggaccacccaccggaacgagccccagcagugggugcugcccagcuacuccggccgcaacacccacaacguccaccucgcgcccgccguggccccgacguuccccggggagcagcugcuguucuuccggagcaccaugcccggcugcuccggcuaccccaacauggaccucgacugccugcugccgcaggagugggugcaguacuucuaccaggaggccgcgcccgcccagagcgacgucgcccuccugcgcuucgugaaccccgacaccgggcgggugcuguucgagugcaagcuccacaaguccggcuacgucaccguggcccacaccgggccccacgaccuggugaucccgcccaacggcuacuuccgcuucgacagcugggucaaccaguucuacacgcuggcccccauggggaacggcaccggccggcgccgcgcgaccuga

SEQ ID NO: 9844 - RNA, 1623 nt, Artificial Sequence
  derived and/or modified sequence opt1 from VP1__Norovirus__ALF12566
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcgacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaugaucguggacgugcggcagcuggagcccguccucaucccgcugcccgacgugcgcaacaacuucuaccacuacaaccaguccaacgaccccacccugaagcucaucgccaugcuguacacgccccugcgggcgaacaacgccggcgacgacguguucaccgucagcugccgcgugcucacccggccgucccccgacuucgacuucaucuuccuggugccgcccaccgucgagagccgcaccaagcccuucuccgugcccgugcugacggucgaggagaugaccaacagccgguuccccaucccccucgagaagcuguucaccggcccguccagcgccuucgugguccagccccagaacgggcgcugcaccacggacggcgugcugcucgggaccacccagcugucccccgugaacaucugcaccuuccggggcgacgucacgcacaucaccggcagccgcaacuacaccaugaaccuggccucccagaacuggaacaacuacgacccgaccgaggagauccccgcgccccucggggcccccgacuucgugggcaagauccaggggaugcugacgcagaccacccggaccgacggcagcacgcgcgggcacaaggccaccguguacaccggcagcgccgacuucgccccgaagcugggccggguccaguucgagaccgacacggaccacgacuucgaggccaaccagaacaccaaguucacccccgugggggugauccaggacggcuccaccacgcaccgcaacgagccccagcaguggguccuccccagcuacuccgggcggaacacccacaacgugcaccuggcgccggccguggcccccaccuuccccggcgagcagcuccuguucuuccgcagcaccaugcccgggugcuccggcuacccgaacauggaccuggacugccugcucccccaggaguggguccaguacuucuaccaggaggccgcgcccgcccagagcgacguggcccugcugcgguucgugaaccccgacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacgggaccggccgccgccggaucguguga

SEQ ID NO: 9845 - RNA, 1623 nt, Artificial Sequence
  derived and/or modified sequence opt1 from VP1__Norovirus__ALF12569
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcagcacgacccaccgcaacgagccccagcagugggugcugcccuccuacagcgggcggaacacccacaacguccaccucgcccccgcgguggccccgaccuuccccggcgagcagcugcccuucuuccgcuccacgaugcccgggugcagcggcuacccgaacauggaccuggacugccuccugccccaggagugggugcaguacuucuaccaggaggccgcccccgcgcaguccgacgucgcccugcuccgguucgugaaccccgacaccggccgcgugcuguucgagugcaagcugcacaagagcggguacgucaccguggcccacaccggccagcacgaccucgugaucccgcccuacggguacuuccgguucgacuccugggucaaccaguucuacacccuggcccccaugggcaacgggacgggccgccgccgggcccuguga

SEQ ID NO: 9846 - RNA, 1623 nt, Artificial Sequence; identical to SEQ ID NO: 9820
  derived and/or modified sequence opt1 from VP1__Norovirus__ALQ28762

SEQ ID NO: 9847 - RNA, 1632 nt, Artificial Sequence
  derived and/or modified sequence opt1 from VP1__Norovirus__ALS03883
augaagauggccagcaacgacgccgcgcccuccaacgacggcgccgccgggcuggugccggagaucaacaacgagaccauggcccucgagcccgucgccggcggggcgaucgccgcgccccugaccggccagacgaacuucaucgaccccuggauccgcgggaacuacgugcaggccccgaacggcgaguucaccgugagcccccggaacucccccggcgagauccugcucaaccuggagcuggggcccgagcucaacccguuccugagccaccugucccgcauguacaacggcuacgccgggggcaucgacguccaggugaucauggccgggaacgccuucaccgccggcaagaucaucuucgccgcgaucccgccccacuuccccguggagaaccucagcccgccccagaucaccauguucccccacaucaucgucgacgugcggacgcuggagcccaucaacauccccgugcccgacguccgcaacaacuucuuccacuacaaccagaacaacgagucccggaugcgccugguggccaugcucuacacgccccugcggagcaacggcuccgccgaggacguguucaccgucagcugccgcgugcugaccaagcccuccgccgacuucgaguucaacuaccucgugccgcccaccgucgagagccggaccaagcccuucaccauccccauccugaccaucggggagaugacgaacucccgcuucccggugcccaucgacaugcugcacaccagccccaccgagaacaucgugguccagccccagaacggccggugcaccaucgacggggagcuccugggcacgacccagcugaucaccuccaacaucugcagcuuccgcggcuccaucagcgggcacgagggcaacgacgaccagcaccucuggcacuucaacaucaccaacccgaacgggacgcccuucgaccccaccgaggacgugccggcgccccugggcacccccgacuuccgggggcagcuguacggcgugaucucccagcgcgaccgggagggcacccccagcgagaacaaccagaaggccaaccgcagccaccagggggucaucuccacgaucagcccgaaguucgugcccaagcucggcuccgugaugaucgggaccuggaccaccgacgacaucaagaaccagcccagcaaguucacgcccaucggccugaacgacgacgacaacuucaagcagugggagcugccgaacuacuccggggcccucacccugaacaugggccuggcccccagcgucuuccccaccuaccccggcgagcagauccucuucuuccgguccuaccugccgcugaagggcggguacgggagccccuucaucgacugccucgugccccaggagugggucgcccacuucuaccaggaguccgcccccgcgcagaccgacguggcccugauccgcuacgugaacccggagacgggccggguccuguucgaggccaagcuccaccgccagggguucaucaccguggccaagagcggcgacucccccaucaacgugcccgccaacggcuacuuccgguucgacagcugggucaaccaguucuacucccuggcgcccauggggaccggcaacgggcgccgccggauccaguga

SEQ ID NO: 9848 - RNA, 1617 nt, Artificial Sequence
  derived and/or modified sequence opt1 from VP1__Norovirus__ALT06546
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacaacaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugccgagcggcaucugcgcguuccgcggccgggucaccgccgagaccgaccaccgcgacaaguggcacaugcagcugcagaaccucaacgggacgaccuacgaccccaccgacgacgugcccgccccgcugggcacccccgacuucaaggggguggucuucggcauggccucccagcggaacguggggaacgacgcccccggcagcacgcgcgcgcacgaggccgucaucuccaccuacagcccccaguucgugccgaagcugggcagcgugaacuuccgguccaacgacaacgacuuccagcuccagcccaccaaguucacccccgucgggaucaacgacgacggcgaccaccccuuccgccagugggagcugccggacuacagcgggccccugacgcucaacaugaaccuggccccgcccguggcccccaacuuccccggcgagcagcuccuguucuuccgguccuucgugcccugcagcgggggcuacaaccagggcaucgucgacugccugaucccccaggaguggauccagcacuucuaccaggaguccgccccgagccaguccgacguggcgcugauccgcuacgugaaccccgacaccgggcggacccucuucgaggccaagcugcaccgcagcggcuacaucaccgucgcccacuccggggacuacccccugguggugcccgccaacggcuacuuccgcuucgacagcugggucaaccaguucuacucccucgcgccgauggggacgggcaacggccggcgccgggcccaguga

SEQ ID NO: 9849 - RNA, 1647 nt, Artificial Sequence
  derived and/or modified sequence opt1 from VP1__Norovirus__BAG30939
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgcccgccagaucaccaugugcccccacgugaucguggacguccggcagcuggagcccgugaaccugcccaugcccgacgugcgcaacaacuucuuccacuacaaccagggcuccgacagccggcuccgccugaucgcgaugcuguacaccccgcuccgggccaacaacuccggcgacgacgucuucacggugagcugccgcgugcugacccggcccucccccgacuucagcuucaacuuccuggugcccccgaccguggaguccaagaccaagcccuucacgcuccccauccugaccaucagcgagauguccaacagccgcuuccccgugccgaucgacucccugcacaccagccccaccgagaacaucgucgugcagugccagaacgggcgggugacgcucgacggcgagcugauggggaccacccagcugcuccccucccagaucugcgccuucaugggcguccugacccgcagcacgucccgggccagcgaccaggccgacaccgcgacgccccgccuguucaacuacuacuggcacauccagcucgacaacccgaacggcacccccuacgaccccgccgaggacaucccggggccccugggcacccccgacuuccgggggaagguguucggcguggccagccagcgcaaccccgacuccaccacccgggcccacgaggccaaggucgacaccacggcggggcgcuucaccccgaagcugggcagccucgagaucuccaccgagagcgacgacuuccaccagaaccagcccacccgguucacgcccgugggcaucggggucgacaacgaggccgacuuccagcaguggucccugcccgacuacagcggccaguucacccacaacaugaaccuggccccggccguggcgcccaacuuccccggggagcagcuccuguucuuccgcucccagcugcccagcuccggcgggcggagcaacggcauccucgacugccuggugccgcaggaguggguccagcacuucuaccaggaguccgcccccagccagacccagguggcccuggugcgcuacgucaaccccgacaccggccgcguccucuucgaggccaagcugcacaagcugggguucaugacgaucgccaagaacggcgacucccccaucaccgugccgcccaacggguacuuccgguucgagagcugggugaaccccuucuacacccucgcgcccaugggcaccgggaacggccgccggcgcauccaguga

SEQ ID NO: 9850 - RNA, 1623 nt, Artificial Sequence; identical to SEQ ID NO: 9292
  derived and/or modified sequence opt1 from VP1__Norovirus__BAG70428

SEQ ID NO: 9851 - RNA, 1623 nt, Artificial Sequence; identical to SEQ ID NO: 9292
  derived and/or modified sequence opt1 from VP1__Norovirus__BAG70431

SEQ ID NO: 9852 - RNA, 1623 nt, Artificial Sequence
  derived and/or modified sequence opt1 from VP1__Norovirus__BAG70434
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacgcccacaacguccaccuggccccggcgguggcccccaccuuccccggggagcagcuccucuucuuccgcuccacgaugcccggcugcagcggcuacccgaacauggaccuggacugccugcucccccaggagugggugcagcacuucuaccaggaggccgcccccgcgcaguccgacgucgcccugcugcgguucgugaaccccgacaccgggcgcguccucuucgagugcaagcugcacaagagcggcuacgugaccguggcccacaccgggcagcacgaccuggugaucccgcccaacggcuacuuccgguucgacuccugggucaaccaguucuacacccucgcccccauggggaacggcacgggccgccggcgcgcccuguga

SEQ ID NO: 9853 - RNA, 1623 nt, Artificial Sequence
  derived and/or modified sequence opt1 from VP1__Norovirus__BAG70437
augaagauggccagcaacgacgccaaccccuccgacggcagcaccgcgaaccuggugccggaggucaacaacgaggugauggcccucgagcccguggucggggccgccaucgccgcgcccguggccggccagaccaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccaaggugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugaucgccaugcucuacacgccccugcgggccaacaacgccggcgaggacguguucaccgugagcugccgcguccugacccggcccuccccggacuucgacuucaucuuccucgugccgcccaccguggagagccgcaccaagcccuucaccguccccauccugaccguggaggagaugacgaacucccgguuccccaucccccuggagaagcuguucaccggccccagcggggcguucgugguccagccgcagaacggccgcugcaccaccgacggggugcugcugggcacgacccagcucucccccgucaacaucugcaccuuccggggcgacgugacccacaucgccgggagccgcaacuacacgaugaaccuggccucccugaacuggaacaacuacgaccccaccgaggagaucccggcgccccucggcacccccgacuucguggggaagauccagggcguccugacccagacgaccaagggggacggcagcacccggggccacaaggccaccguguacacgggguccgcccccuucaccccgaagcugggcagcgugcaguucagcaccgacaccgagaacgacuucgagacgcaccagaacaccaaguucacccccgucggggugauccaggacggcuccaccacgcaccgcaacgagccccagcagugggugcuccccagcuacuccgggcggaacguccacaacgugcaccuggccccggccguggcccccaccuuccccggcgagcagcuccucuucuuccgcagcaccaugcccggcugcuccggguacccgaacauggaccuggacugccugcucccccaggaguggguccagcacuucuaccaggaggccgcgcccgcccagagcgacguggcccugcugcgguucgugaaccccgacaccggccgcguccucuucgagugcaagcugcacaaguccggguacgugaccguggcccacacgggccagcacgaccuggucaucccgcccaacggguacuuccgguucgacagcugggugaaccaguucuacacccucgcgcccaugggcaacggcaccgggcgccggcgcgcccuguga

SEQ ID NO: 9854 - RNA, 1623 nt, Artificial Sequence
  derived and/or modified sequence opt1 from VP1__Norovirus__BAG70440
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccgcaacuacaccaugaaccuggccagccugaacuggaacaacuacgaccccacggaggagaucccggcgccccucgggacccccgacuucgugggcaagauccaggggguccugacccagaccacgaagggcgacggguccacccggggccacaaggccaccguguacaccggcagcgcccccuucacgccgaagcuggggagcgugcaguucuccaccgacaccgagaacgacuucgagacccaccagaacacgaaguucacccccgucggcgugauccaggacgggggcaccacccaccgcaacgagccccagcagugggugcuccccagcuacuccgggcggaacguccacaacgugcaccuggccccggccguggcccccacguuccccggcgagcagcuccucuucuuccgcagcaccaugcccggcugcuccggguacccgaacauggaccuggacugccugcucccccaggaguggguccagcacuucuaccaggaggcggcccccgcccagagcgacguggcccugcugcgguucgugaaccccgacaccggccgcguccucuucgagugcaagcugcacaaguccggguacgugaccguggcguacaccggccagcacgaccuggucaucccgcccaacggguacuuccgguucgacagcugggugaaccaguucuacacgcucgcccccaugggcaacggcaccgggcgccggcgcgcccuguga

SEQ ID NO: 9855 - RNA, 1623 nt, Artificial Sequence
  derived and/or modified sequence opt1 from VP1__Norovirus__BAG70446
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccggcacccaggaguacaccaugaaccuggccucccagaacuggaacaacuacgacccgacggaggagauccccgcgccccugggcacccccgacuucguggggaagauccagggcguccucacccagaccacgcggcgggacgggagcacccgcggccacaaggccaccgugagcaccggguccgugcacuucacgccgaagcugggccggauccaguucagcaccgacaccuccaacgacuucgagaccggccagaacacgcgcuucacccccgucgggguggugcaggacggcagcaccacccaccagaacgagccccagcaguggguccugcccaacuacuccgggcgggacagccacaacgugcaccucgccccggccguggcccccuccuuccccggcgagcagcugcuguucuuccgcagcacgaugcccgggugcuccggcuacccgaacaugaaccucgacugccugcugccccaggaguggguccagcacuucuaccaggaggccgcgcccgcccagagcgacguggcccuccugcgguucgugaaccccgacaccggccgcguccuguucgagugcaagcuccacaaguccggguacgugaccguggcccacaccggccagcacgaccuggucaucccgcccaacggguacuuccgguucgacagcugggugaaccaguucuacacccuggcgcccaugggcaacgggacgggccgccgccgggcccucuga

SEQ ID NO: 9856 - RNA, 1623 nt, Artificial Sequence
  derived and/or modified sequence opt1 from VP1__Norovirus__BAG70449
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacagcuacgccggcggguucgaggugcaggucauccucgccggcaacgccuucaccgccgggaagaucaucuucgccgccgugccgcccaacuucccgacggagggccugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggcgaacaacgccggggaggacguguucaccgugagcugccgcguccugacccggccgucccccgacuucgacuucaucuuccucgugccgcccaccguggagagccgcaccaagcccuucacgguccccauccugaccguggaggagaugaccaacucccgguuccccaucccccuggagaagcuguucaccggcccgagcggcgccuucgugguccagccccagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgacccgaccgaggagauccccgcgccccucgggacgcccgacuucgugggcaagauccaggggguccugacccagaccaccaagggcgacgggagcacgcggggccacaaggccaccguguacaccggcuccgccccguucacccccaagcuggggagcgugcaguucagcacggacaccgagaacgacuucgagacccaccagaacaccaaguucacgcccgucggcgugauccaggacggguccaccacccaccgcaacgagccccagcagugggugcucccgagcuacuccggccggaacguccacaacgugcaccuggcccccgccguggcgcccaccuuccccggggagcagcuccucuucuuccgcagcacgaugccgggcugcuccggcuaccccaacauggaccuggacugccugcucccccaggaguggguccagcacuucuaccaggaggccgcccccgcccagagcgacguggcgcugcugcgguucgugaacccggacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcccuguga

SEQ ID NO: 9857 - RNA, 1623 nt, Artificial Sequence
  derived and/or modified sequence opt1 from VP1__Norovirus__BAG70452
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagcugaacgacagcaccaucaagcucaucgccaugcuguacacgccccugcgggcgaacaacgccggcgaggacguguucaccguguccugccgcguccucacccggcccagcccggacuucgacuucaucuuccuggugccgcccaccguggagucccgcacgaagcccuucaccguccccauccugaccguggaggagaugaccaacagccgguuccccaucccccucgagaagcuguucacgggccccuccggggccuucgugguccagccgcagaacggccgcugcaccaccgacggggugcugcucggcaccacgcagcugagccccgucaacaucugcaccuuccggggcgacgugacccacaucgccgggucccgcaacuacaccaugaaccuggccagccucaacuggaacaacuacgaccccacggaggagaucccggcgccccugggcacccccgacuucguggggaagauccagggcguccugacccagaccacgaagggggacggcuccacccggggccacaaggccaccguguacaccgggagcgcccccuucacgccgaagcucggcuccgugcaguucagcaccgacaccgagaacgacuucgagacccaccagaacacgaaguucacccccgucggggugauccaggacggcagcaccacccaccgcaacgagccccagcagugggugcugcccuccuacagcgggcggaacguccacaacgugcaccuggccccggccguggcgcccacguuccccggcgagcagcuccuguucuuccgcuccaccaugcccggcugcagcggguacccgaacauggaccuggacugccuccugccccaggaguggguccagcacuucuaccaggaggccgcccccgcccaguccgacguggcgcugcuccgguucgugaaccccgacaccggccgcguccuguucgagugcaagcugcacaagagcggguacgugaccguggcccacaccggccagcacgaccucgucaucccgcccaacggguacuuccgguucgacuccugggugaaccaguucuacacgcuggcccccaugggcaacggcaccgggcgccggcgcgcccuguga

SEQ ID NO: 9858 - RNA, 1623 nt, Artificial Sequence; identical to SEQ ID NO: 9162
  derived and/or modified sequence opt1 from VP1__Norovirus__BAG70458

SEQ ID NO: 9859 - RNA, 1623 nt, Artificial Sequence; identical to SEQ ID NO: 8840
  derived and/or modified sequence opt1 from VP1__Norovirus__BAG70461

SEQ ID NO: 9860 - RNA, 1623 nt, Artificial Sequence; identical to SEQ ID NO: 8840
  derived and/or modified sequence opt1 from VP1__Norovirus__BAG70464

SEQ ID NO: 9861 - RNA, 1623 nt, Artificial Sequence; identical to SEQ ID NO: 8840
  derived and/or modified sequence opt1 from VP1__Norovirus__BAG70467

SEQ ID NO: 9862 - RNA, 1623 nt, Artificial Sequence; identical to SEQ ID NO: 9292
  derived and/or modified sequence opt1 from VP1__Norovirus__BAG70470

SEQ ID NO: 9863 - RNA, 1623 nt, Artificial Sequence; identical to SEQ ID NO: 9292
  derived and/or modified sequence opt1 from VP1__Norovirus__BAG70473

SEQ ID NO: 9864 - RNA, 1623 nt, Artificial Sequence
  derived and/or modified sequence opt1 from VP1__Norovirus__BAG70476
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcuccugggcaccacccagcucucccccgucaacaucugcacguuccggggcgacgugacccacaucgccgggagccgcaacuacaccaugaaccuggccucccugaacuggaacaacuacgaccccaccgaggagcucccggcgccccugggcacgcccgacuucguggggaagauccagggcguccugacccagaccaccaagggggacggcagcacgcggggccacaaggccaccguguacaccggguccgcccccuucaccccgaagcucggcagcgugcaguucagcacggacaccgagaacgacuucgagacccaccagaacaccaaguucacgcccgucggggugauccaggacggcuccaccacccaccgcaacgagccccagcagugggugcugcccagcuacuccgggcggaacguccacaacgugcaccuggccccggccguggcgcccaccuuccccggcgagcagcuccuguucuuccgcagcacgaugcccggcugcuccggguacccgaacauggaccuggacugccuccugccccaggaguggguccagcacuucuaccaggaggccgcccccgcccagagcgacguggcgcugcuccgguucgugaaccccgacaccggccgcguccuguucgagugcaagcugcacaaguccggguacgugaccguggcccacaccggccagcacgaccucgucaucccgcccaacggguacuuccgguucgacagcugggugaaccaguucuacacccuggcccccaugggcaacggcacggggcgccggcgcgcccuguga

SEQ ID NO: 9865 - RNA, 1623 nt, Artificial Sequence
  derived and/or modified sequence opt1 from VP1__Norovirus__BAG70482
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggacgggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9866 - RNA, 1623 nt, Artificial Sequence; identical to SEQ ID NO: 8840
  derived and/or modified sequence opt1 from VP1__Norovirus__BAG70485

SEQ ID NO: 9867 - RNA, 1623 nt, Artificial Sequence; identical to SEQ ID NO: 8840
  derived and/or modified sequence opt1 from VP1__Norovirus__BAG70488

SEQ ID NO: 9868 - RNA, 1623 nt, Artificial Sequence
  derived and/or modified sequence opt1 from VP1__Norovirus__BAG70491
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgucagcacgggcagcguggacuucaccccgaagcugggguccgugcaguucgccaccgacaccgacaacgacuucgagacgggccagaacacccgguucacccccgucggggugauccaggacggcagcuccacccaccgcaacgagccccagcagugggugcugcccgacuacagcgggcggacggcccacaacguccaccucgccccggccguggcccccaccuuccccggcgagcagcugcuguucuuccgcuccaccaugcccggcugcagcggguacccgaacauggaccucgacugccugcugccccaggagugggugcagcacuucuaccaggaggcggcccccucccagagcgacgucgcccuccugcgguucgugaaccccgacaccggccgcgugcuguucgagugcaagcuccacaaggccggguacgucaccguggcgcacacgggccagcacgaccuggugaucccgcccaacggguacuuccgguucgacuccugggucaaccaguucuacacccuggcccccaugggcaacggcgccgggcgccgccgggcccucuga

SEQ ID NO: 9869 - RNA, 1623 nt, Artificial Sequence
  derived and/or modified sequence opt1 from VP1__Norovirus__BAG70494
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcgacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccacuucuacacccucgcccccaugggcaacggcacggggcgccggcgcgcccuguga

SEQ ID NO: 9870 - RNA, 1623 nt, Artificial Sequence; identical to SEQ ID NO: 9162
  derived and/or modified sequence opt1 from VP1__Norovirus__BAG70497

SEQ ID NO: 9871 - RNA, 1623 nt, Artificial Sequence; identical to SEQ ID NO: 9332
  derived and/or modified sequence opt1 from VP1__Norovirus__BAG70503

SEQ ID NO: 9872 - RNA, 1623 nt, Artificial Sequence; identical to SEQ ID NO: 9162
  derived and/or modified sequence opt1 from VP1__Norovirus__BAG70506

SEQ ID NO: 9873 - RNA, 1623 nt, Artificial Sequence
  derived and/or modified sequence opt1 from VP1__Norovirus__BAG70509
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggacccgcaacuacaccaugaaccuggccagccugaacuggaacaacuacgaccccacggaggagaucccggcgccccucggcacccccgacuucguggggaagauccagggcguccugacccagaccacgaagggggacggcuccacccggggccacaaggccaccguguacaccgggagcgcccccuucacgccgaagcugggcuccgugcaguucagcaccgacaccgagaacgacuucgagacccaccagaacacgaaguucacccccgucggggugauccaggacggcgggaccacccaccgcaacgagccccagcagugggugcuccccagcuacuccggccggaacguccacaacgugcaccuggccccggccguggcgcccacguuccccggcgagcagcuccucuucuuccgcagcaccaugcccgggugcuccggcuacccgaacaugaaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacgcucgcccccaugggcaacgggaccggccgccggcgcgcccuguga

SEQ ID NO: 9874 - RNA, 1623 nt, Artificial Sequence
  derived and/or modified sequence opt1 from VP1__Norovirus__BAG70512
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggacccgcaacuacaccaugaaccuggccagccuguccuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccggaacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugaugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacgcuggcccccaugggcaacgggaccggccgccggcgcgcccucuga

SEQ ID NO: 9875 - RNA, 1623 nt, Artificial Sequence
  derived and/or modified sequence opt1 from VP1__Norovirus__BAG70515
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcuccugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggccugcugacccagaccaccaagggggacggcagcacgcggggccacaaggccaccgucuacaccggguccgcccccuucaccccgaagcucggcagcgugcaguucagcacggacaccgagaacgacuucgagacccaccagaacaccaaguucacgcccgugggggucauccaggacggcuccaccacccaccgcaacgagccccagcagugggugcugcccagcuacuccgggcggaacgugcacaacguccaccuggccccggccguggcgcccaccuuccccggcgagcagcuccuguucuuccgcagcacgaugcccggcugcuccggguacccgaacauggaccuggacugccuccugccccaggagugggugcagcacuucuaccaggaggccgcccccgcccagagcgacgucgcgcugcuccgguucgugaaccccgacaccggccgcgugcuguucgagugcaagcugcacaaguccggguacgucaccguggcccacaccggccagcacgaccucgugaucccgcccaacggguacuuccgguucgacagcugggucaaccaguucuacacccuggcccccaugggcaacggcacggggcgccggcgcgcccuguga

SEQ ID NO: 9876 - RNA, 1623 nt, Artificial Sequence; identical to SEQ ID NO: 9875
  derived and/or modified sequence opt1 from VP1__Norovirus__BAG70518

SEQ ID NO: 9877 - RNA, 1623 nt, Artificial Sequence
  derived and/or modified sequence opt1 from VP1__Norovirus__BAG70521
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacggccgcugcacgaccgacgggguccuccugggcaccacccagcucagccccgugaacaucugcacguuccgcggggacgugacccacaucgccggcacccaggaguacaccaugaaccuggccucccagaacuggaacaacuacgacccgacggaggagauccccgcgccccugggcacccccgacuucgucgggaagauccagggcgugcucacccagaccacgcggcgggacgggagcacccgcggccacaaggccaccgugagcaccggguccguccacuucacgccgaagcugggccggauccaguucagcaccgacaccuccaacgacuucgagaccggccagaacacgcgcuucacccccgugggggugguccaggacggcgggaccacccaccagaacgagccccagcagugggugcugcccaacuacagcggccgggacucccacaacgugcaccucgccccggccgucgcccccagcuuccccggggagcagcugcuguucuuccgcuccacgaugcccggcugcagcggcuacccgaacaugaaccucgacugccugcugccccaggagugggugcagcacuucuaccaggaggccgcgcccgcccaguccgacguggcccuccugcgguucgucaaccccgacaccgggcgcgugcuguucgagugcaagcuccacaagagcggcuacgugaccgucgcccacaccgggcagcacgaccuggugaucccgcccaacggcuacuuccgguucgacuccugggugaaccaguucuacacccuggcgcccauggggaacggcacgggccgccgccgggcccucuga

SEQ ID NO: 9878 - RNA, 1623 nt, Artificial Sequence
  derived and/or modified sequence opt1 from VP1__Norovirus__BAG70524
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcuccugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggccugcugacccagaccaccaagggggacggcagcacgcggggccacaaggccaccgucuacaccggguccgcccccuucaccccgaagcucggcagcgugcaguucagcacggacaccgagaacgacuucgagacccaccagaacaccaaguucacgcccgugggggucauccaggacggcuccaccacccaccgcaacgagccccagcagugggugcugcccagcuacuccgggcggaacgugcacaacguccaccuggccccggccguggcgcccaccuuccccggcgagcagcucaucuucuuccgcagcacgaugcccggcugcuccggguacccgaacauggaccuggacugccugcucccccaggagugggugcagcacuucuaccaggaggccgcccccgcccagagcgacgucgcgcugcugcgguucgugaaccccgacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcacggggcgccggcgcgcccuguga

SEQ ID NO: 9879 - RNA, 1623 nt, Artificial Sequence
  derived and/or modified sequence opt1 from VP1__Norovirus__BAG70527
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcuccugggcaccacccagcucucccccgucaacaucugcacguuccggggcgacgugacccacaucgccgggagccgcaacuacaccaugaaccuggccucccugaacuggaacagcuacgaccccaccgaggagaucccggcgccccucggcacgcccgacuucguggggaagauccagggccugcugacccagaccaccaagggggacggcuccacgcggggccacaaggccaccgucuacaccgggagcgcccccuucaccccgaagcucggcagcgugcaguucuccacggacaccgagaacgacuucgagacccaccagaacaccaaguucacgcccgugggggucauccaggacggcagcaccacccaccgcaacgagccccagcagugggugcugcccuccuacagcgggcggaacgugcacaacguccaccuggccccggccguggcgcccaccuuccccggcgagcagcuccuguucuuccgcuccacgaugcccggcugcagcggguacccgaacauggaccuggacugccuccugccccaggagugggugcagcacuucuaccaggaggccgcccccgcccaguccgacgucgcgcugcuccgguucgugaaccccgacaccggccgcgugcuguucgagugcaagcugcacaagagcggguacgucaccguggcccacaccggccagcacgaccucgugaucccgcccaacggguacuuccgguucgacuccugggucaaccaguucuacacccuggcccccaugggcaacggcacggggcgccggcgcgcccuguga

SEQ ID NO: 9880 - RNA, 1623 nt, Artificial Sequence; identical to SEQ ID NO: 9875
  derived and/or modified sequence opt1 from VP1__Norovirus__BAG70530

SEQ ID NO: 9881 - RNA, 1623 nt, Artificial Sequence; identical to SEQ ID NO: 9875
  derived and/or modified sequence opt1 from VP1__Norovirus__BAG70533

SEQ ID NO: 9882 - RNA, 1623 nt, Artificial Sequence; identical to SEQ ID NO: 9875
  derived and/or modified sequence opt1 from VP1__Norovirus__BAG70536

SEQ ID NO: 9883 - RNA, 1623 nt, Artificial Sequence; identical to SEQ ID NO: 9441
  derived and/or modified sequence opt1 from VP1__Norovirus__BAI70518

SEQ ID NO: 9884 - RNA, 1623 nt, Artificial Sequence
  derived and/or modified sequence opt1 from VP1__Norovirus__BAJ13508
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggaacaacuacgaccccacggaggagaucccggcgccccuggggacccccgacuucgugggcaagauccaggggaugcucacccagaccacgcgcagcgacggcuccacccgggggcacaaggccaccguccugaccggcagcgccgacuucgcccccaagcugggccgcgugcaguucgccacggacaccgacaacgacuucgagagcgggcagaacaccaaguucaccccggugggcgucauccaggacggguccacgacccaccggaacgagccccagcagugggugcuccccaacuacagcggccgcaccgggcacaacgugcaccuggcgcccgccgucgccccgaccuaccccggcgagcagcuccuguucuuccgguccacgaugcccggcugcagcggguaccccaacauggaccuggacugccugcucccgcaggagugggugcagcacuucuaccaggaggccgcgcccgcccaguccgacauggcccugcugcgcuucgugaaccccgacaccggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcacggggcgccggcgcgcgguguga

SEQ ID NO: 9885 - RNA, 1623 nt, Artificial Sequence
  derived and/or modified sequence opt1 from VP1__Norovirus__BAJ13513
augaagauggccagcuccgacgccaacccgcccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgccccgcugggccccgaccucaaccccuaccugucccaccuggcccgcauguacaacggcuacgccgggggcuucgaggugcaggucauccucgccgggaacgcguucaccgccggcaagaucaucuucgccgccgugcccccgaacuuccccacggaggggcugagccccucccaggugaccauguucccccacaucaucgucgacgugcggcagcuggagccggugcucaucccccugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggccgucccccgacuucgacuucaucuuccucgugccgcccaccguggagagccgcaccaagcccuucacgguccccauccugaccguggaggagaugaccaacucccgguuccccaucccccuggagaagcuguucaccggcccgagcggggccuucgugguccagccccagaacggccgcugcacgaccgacggggugcugcugggcaccacccagcucucccccgucaacaucugcacguuccggggcgacgccacccacaucgccgggagccgcuccuacaccaugaaccuggcgagccugaacuggaacaacuacgacccgaccgaggagauccccgcgccccucggcacgcccgacuucguggggaagauccagggcaugcugacccagaccaccaagggggacggcuccacgcggggccacaaggccaccguguacaccgggagcgccccguucacccccaagcugggcagcguccaguucuccacggacaccgagaacgacuuccagacccaccagaacaccaaguucacgcccgugggggugauccaggacggcagcaccacccaccgcaacgagccccagcaguggguccucccguccuacagcgggcgggacgugcacaacgugcaccuggcccccgccgucgcccccaccuuccccggcgagcagcuccucuucuuccgcuccacgaugccgggcugcagcggguaccccaacauggaccuggacugccugcucccccaggagugggugcagcacuucuaccaggaggccgcccccgcgcaguccgacguggcccugcugcgguucgucaacccggacaccggccgcguccucuucgagugcaagcugcacaagagcggguacgugaccguggcccacaccggccagcacgaccuggugaucccgcccaacggguacuuccgguucgacuccugggugaaccaguucuacacccucgcccccaugggcaacggcacggggcgccggcgcgcccuguga

SEQ ID NO: 9886 - RNA, 1623 nt, Artificial Sequence
  derived and/or modified sequence opt1 from VP1__Norovirus__BAJ13520
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcaugcugacccagaccaccaagggggacggcuccacgcggggccacaaggccaccgucuacaccgggagcgcccccuucaccccgaagcugggcaacgugcaguucagcacggacaccgagaacgacuucgagacccaccagaacaccaaguucacgcccgugggggucauccaggacggcuccaccacccaccgcaacgagccccagcagugggugcuccccagcuacuccgggcgggacgugcacaacguccaccuggccccggccguggcgcccaccuuccccggcgagcagcuccucuucuuccgcagcacgaugcccggcugcuccggguacccgaacauggaccuggacugccugcucccccaggagugggugcagcacuucuaccaggaggccgcccccgcccagagcgacgucgcgcugcugcgguucgugaaccccgacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcacggggcgccggcgcgcccuguga

SEQ ID NO: 9887 - RNA, 1623 nt, Artificial Sequence
  derived and/or modified sequence opt1 from VP1__Norovirus__BAJ13534
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcuccgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccagaacaccaaguucacgcccgucggggugauccaggacggcagcaccacccaccgcaacgagccccagcagugggugcuccccuccuacagcgggcggaacguccacaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 9888 - RNA, 1623 nt, Artificial Sequence
  derived and/or modified sequence opt1 from VP1__Norovirus__BAJ13537
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucgugcucgccgggaacgccuucacggcgggcaagaucaucuucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgaccccaccaucaagcugaucgccaugcucuacacgccccugcgggccaacaacgcgggcgacgacguguucaccgucagcugccgcgugcugacccggccgucccccgacuucgacuucaucuuccucgugccgcccaccgucgagagccgcacgaagcccuucuccgugcccauccugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucaccggcagccgcaacuacaccaugaaccuggccacgcagaacuggaacuccuacgacccgaccgaggagauccccgcgccccuggggacccccgacuucgucggcaagauccagggggugcucacccagacgacccgggccgacggcagcacccgcgggcacaaggccaccguguacacgggcagcgccgacuucgccccgaagcugggccggguccaguucgccaccgacaccgacaacgacuucgacgccaaccagaacaccaaguucacgcccgugggggugauccaggacggcgacaccgcgcaccgcaacgagccccagcaguggguccugcccuccuacagcgggcggaacaaccacaacgugcaccucgccccggccguggcccccaccuuccccggcgagcagcugcuguucuuccgcuccaccaugcccgggugcagcggcuacccgaacauggaccucgacugccugcugccccaggaguggguccaguacuucuaccaggaggcggcccccgcccaguccgacguggcccuccugcgguucgugaaccccgacacgggccgcguccuguucgagugcaagcuccacaagagcggguacgugaccguggcccacaccggccagcacgaccuggucaucccgcccaacggguacuuccgguucgacuccugggugaaccaguucuacacccuggcgcccaugggcaacgggaccggccgccgccgggcccucuga

SEQ ID NO: 9889 - RNA, 1623 nt, Artificial Sequence
  derived and/or modified sequence opt1 from VP1__Norovirus__BAJ13540
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucguggggagccgcaacuacaccaugaaccuggccucccugaacuggaacaacuacgaccccacggaggagaucccggcgccccucggcacccccgacuucgucgggaagauccagggcgugcugacccagaccacgaagggggacggcagcacccggggccacaaggccaccguguacaccggguccgcccccuucacgccgaagcugggcagcguccaguucagcaccgacaccgagaacgacuucgaggcccaccagaacaccaaguucacgcccgugggggugauccaggacggcuccaccacccaccgcaacgagccccagcaguggguccuccccagcuacuccgggcggaacgugcagaacgugcaccuggccccggccgucgcgcccaccuuccccggcgagcagcuccucuucuuccgcagcacgaugcccggcugcuccggguacccgaacauggaccuggacugccugcucccccaggagugggugcagcacuucuaccaggaggccgcccccgcccagagcgacguggcgcugcugcgguucgucaaccccgacaccggccgcguccucuucgagugcaagcugcacaaguccggguacgugaccguggcccacaccggccagcacgaccuggugaucccgcccaacggguacuuccgguucgacagcugggugaaccaguucuacacccucgcccccaugggcaacggcacggggcgccggcgcgcccuguga

SEQ ID NO: 9890 - RNA, 1623 nt, Artificial Sequence; identical to SEQ ID NO: 9852
  derived and/or modified sequence opt1 from VP1__Norovirus__BAJ13543

SEQ ID NO: 9891 - RNA, 1623 nt, Artificial Sequence; identical to SEQ ID NO: 9852
  derived and/or modified sequence opt1 from VP1__Norovirus__BAJ13549

SEQ ID NO: 9892 - RNA, 1623 nt, Artificial Sequence
  derived and/or modified sequence opt1 from VP1__Norovirus__BAJ13552
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgaggcccaccagaacaccaaguucacgcccgucggggugauccaggacggcuccaccacccaccgcaacgagccccagcagugggugcuccccagcuacuccgggcggaacguccagaacgugcaccuggccccggcgguggcccccaccuuccccggcgagcagcuccucuucuuccgcagcacgaugcccggcugcuccggguacccgaacauggaccuggacugccugcucccccaggaguggguccagcacuucuaccaggaggccgcccccgcgcagagcgacguggcccugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9893 - RNA, 1623 nt, Artificial Sequence
  derived and/or modified sequence opt1 from VP1__Norovirus__BAJ13555
augaagauggccagcaacgaccccucccccagcgacggcuccgccgcgaaccuggugcccgaggucaacaacgaggugauggcccucgagcccguggucggggccgccaucgccgcgcccguggccggccagcagaacgugaucgacccguggauccgcaacaacuucguccaggcccccgggggcgaguucaccgugagcccccggaacgcccccggggagauccugugguccgcgccgcugggccccgaccucaaccccuaccugagccaccuggcccgcauguacaacggcuacgccgggggcuucgaggugcaggucauccucgccgggaacgccuucaccgcgggcaagaucaucuucgccgccgugcccccgaacuuccccacggaggggcugucccccagccaggugaccauguucccccacaucaucgucgacgugcggcagcuggagccggugcucaucccccugcccgacguccgcaacaacuucuaccacuacaaccaguccaacgacagcaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcaccaagcccuucacgguccccauccugaccguggaggagaugaccaacagccgguuccccaucccccuggagaagcuguucaccggcccguccagcgccuucgugguccagccccagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgacccgaccgaggagauccccgcgccccucgggacgcccgacuucgugggcaagauccaggggguccugacccagaccaccaagggcgacgggagcacgcggggccacaaggccaccguguacaccggcagcgccccguucacccccaagcugggguccgugcaguucagcacggacaccgagaacgacuucgagacccaccagaacaccaaguucacgcccgucggcgugauccaggacgggggcaccacccaccgcaacgagccccagcagugggugcucccguccuacagcgggcgggacguccagaacgugcaccuggcccccgccguggcccccaccuuccccggcgagcagcuccucuucuuccgcuccacgaugccgggcugcagcggguaccccaacauggaccuggacugccugcucccccaggaguggguccagcacuucuaccaggaggcggcccccgcccaguccgacguggcccugcugcgguucgugaacccggacaccggccgcguccucuucgagugcaagcugcacaagagcggguacgugaccguggcgcacaccggccagcacgaccuggucaucccgcccaacggguacuuccgguucgacuccugggugaaccaguucuacacccucgcccccaugggcaacggcacggggcgccggcgcgcccuguga

SEQ ID NO: 9894 - RNA, 1623 nt, Artificial Sequence; identical to SEQ ID NO: 9892
  derived and/or modified sequence opt1 from VP1__Norovirus__BAJ13558

SEQ ID NO: 9895 - RNA, 1623 nt, Artificial Sequence; identical to SEQ ID NO: 9162
  derived and/or modified sequence opt1 from VP1__Norovirus__BAJ13561

SEQ ID NO: 9896 - RNA, 1623 nt, Artificial Sequence
  derived and/or modified sequence opt1 from VP1__Norovirus__BAJ13564
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaucaugaaccuggccagccugaacuggaacaacuacgaccccaccgaggagaucccggcgccccucgggacccccgacuucgugggcaagauccaggggguccugacgcagaccaccaagggcgacggguccacccggggccacaaggccacgguguacaccggcagcgcccccuucaccccgaagcuggggagcgugcaguucuccaccgacacggagaacgacuucgagacccaccagaacaccaaguucacccccgucggcgugauccaggacgggagcacgacccaccgcaacgagccccagcagugggugcuccccuccuacagcggccggaacguccacaacgugcaccuggccccggccguggcgcccaccuuccccggggagcagcuccucuucuuccgcuccaccaugcccggcugcagcggcuacccgaacauggaccuggacugccugcucccccaggaguggguccagcacuucuaccaggaggccgcccccgcccaguccgacguggcgcugcugcgguucgugaaccccgacacggggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcaccggccgccggcgcgcccuguga

SEQ ID NO: 9897 - RNA, 1623 nt, Artificial Sequence
  derived and/or modified sequence opt1 from VP1__Norovirus__BAJ13567
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcgacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcgcuucuccacggacaccgagaacgacuucgagacccaccagaacaccaaguucacgcccgucggcgugauccaggacgggagcaccacccaccggaacgagccccagcagugggugcuccccuccuacagcggccgcgacguccacaacgugcaccuggccccggccguggcgcccaccuuccccggggagcagcuccucuucuuccgguccacgaugcccggcugcagcggcuacccgaacauggaccuggacugccugcucccccaggaguggguccagcacuucuaccaggaggccgcccccgcccaguccgacguggcgcugcugcgcuucgugaaccccgacaccgggcggguccucuucgagugcaagcugcacaagccgggcuacgugaccguggcccacaccgggcagcacgaccuggucaucccgcccaacggcuacuuccgcuucgacagcugggugaaccaguucuacacccucgcccccauggggaacggcacgggccggcgccgcgcccuguga

SEQ ID NO: 9898 - RNA, 1623 nt, Artificial Sequence; identical to SEQ ID NO: 9892
  derived and/or modified sequence opt1 from VP1__Norovirus__BAJ13573

SEQ ID NO: 9899 - RNA, 1623 nt, Artificial Sequence
  derived and/or modified sequence opt1 from VP1__Norovirus__BAJ13576
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccccugguccgagccgcugggccccgaccugaaccccuaccucucccaccuggcccgcauguacaacggcuacgccgggggcuucgaggugcaggucauccuggccgggaacgccuucaccgcgggcaagaucaucuucgccgccgugcccccgaacuuccccacggaggggcucagccccucccaggugaccauguucccccacaucaucgucgacgugcggcagcuggagccggugcugaucccccuccccgacguccgcaacaacuucuaccacuacaaccagagcaacgacuccaccaucaagcugaucgccaugcuguacacgccccuccgggccaacaacgcgggcgaggacguguucaccgugagcugccgcguccugacccggccgucccccgacuucgacuucaucuuccuggugccgcccaccguggagagccgcaccaagccguucacgguccccauccucaccguggaggagaugaccaacucccgguuccccaucccccuggagaagcuguucaccggcccgagcuccgccuucgugguccagccccagaacgggcgcugcacgaccgacggcgugcuccuggggaccacccagcugagccccgucaacaucugcacguuccggggcgacgugacccacaucgccggcucccgcaacuacaccaugaaccucgccagccugaacuggaacaacuacgacccgaccgaggagauccccgcgccccuggggacgcccgacuucgugggcaagauccaggggguccucacccagaccaccaagggcgacggguccacgcggggccacaaggccaccguguacaccggcagcgccgacuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcugcccagcuacuccgggcggaacguccacaacgugcaccucgccccggccguggcccccaccuuccccggcgagcagcugcuguucuuccgcagcacgaugcccggcugcuccggguacccgaacauggaccucgacugccugcugccccaggaguggguccagcacuucuaccaggaggcggcccccgcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacggcacggggcgccggcgcgcccucuga

SEQ ID NO: 9900 - RNA, 1623 nt, Artificial Sequence
  derived and/or modified sequence opt1 from VP1__Norovirus__BAJ13579
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucuccacggacaccgagaacgacuucgagacccaccagaacaccaaguucacgccggucggcgugauccaggacgggggcaccacccaccgcaacgagccccagcagugggugcuccccagcuacuccgggcggaacguccacaacgugcaccuggcccccgccguggcgccgaccuuccccggcgagcagcuccucuucuuccgcagcacgaugcccggcugcuccggguaccccaacauggaccuggacugccugcucccgcaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9901 - RNA, 1623 nt, Artificial Sequence; identical to SEQ ID NO: 9292
  derived and/or modified sequence opt1 from VP1__Norovirus__BAJ13582

SEQ ID NO: 9902 - RNA, 1623 nt, Artificial Sequence; identical to SEQ ID NO: 9441
  derived and/or modified sequence opt1 from VP1__Norovirus__BAJ13585

SEQ ID NO: 9903 - RNA, 1623 nt, Artificial Sequence
  derived and/or modified sequence opt1 from VP1__Norovirus__BAJ13591
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcuguacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9904 - RNA, 1623 nt, Artificial Sequence
  derived and/or modified sequence opt1 from VP1__Norovirus__BAJ13594
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcaugcugacccagaccaccaagggggacggcuccacgcggggccacaaggccaccgucuacaccgggagcgcccccuucaccccgaagcugggcagcgugcaguucuccacggacaccgagaacgacuucgagacccaccagaacaccaaguucacgcccgugggggucauccaggacggcagcaccacccaccgcaacgagccccagcagugggugcuccccuccuacagcgggcgggacgugcacaacguccaccuggccccggccguggcgcccaccuuccccggcgagcagcuccucuucuuccgcuccacgaugcccggcugcagcggguacccgaacauggaccuggacugccugcucccccaggagugggugcagcacuucuaccaggaggccgcccccgcccaguccgacgucgcgcugcugcgguucgugaaccccgacaccggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacggcacggggcgccggcgcgcccuguga

SEQ ID NO: 9905 - RNA, 1623 nt, Artificial Sequence; identical to SEQ ID NO: 9892
  derived and/or modified sequence opt1 from VP1__Norovirus__BAJ13597

SEQ ID NO: 9906 - RNA, 1623 nt, Artificial Sequence
  derived and/or modified sequence opt1 from VP1__Norovirus__BAJ13603
augaagauggccagcaacgacgccaaccccuccgacggcagcgcggccaaccuggugcccgaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacgucccgaacgugcaccuggcccccgccguggcgcccaccuuccccggcgagcagcuccucuucuuccgcuccacgaugccgggcugcagcggguaccccaacauggaccuggacugccugcucccccaggaguggguccagcacuucuaccaggaggccgcccccgcccaguccgacguggcgcugcugcgguucgugaacccggacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 9907 - RNA, 1623 nt, Artificial Sequence
  derived and/or modified sequence opt1 from VP1__Norovirus__BAJ13606
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcgacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccggcgacgacuuccagacccaccagaacaccaaguucacgcccgucggggugauccaggacggcgggaccacccaccgcaacgagccccagcagugggugcuccccuccuacagcggccggaacgucccgaacgugcaccuggcccccgccguggcgcccaccuuccccggcgagcagcuccucuucuuccgcuccacgaugccggggugcagcggcuaccccaacauggaccuggacugccugcucccccaggaguggguccagcacuucuaccaggaggccgcccccgcccaguccgacguggcgcugcugcgguucgugaacccggacaccgggcgcguccucuucgagugcaagcugcacaaggccggcuacgugaccguggcccacaccgggcagcacgaccuggucaucccgcccaacggcuacuuccgguucgacagcugggugaaccaguucuacacccucgcccccaugggcaacgggacgggccgccggcgcgcccuguga

SEQ ID NO: 9908 - RNA, 1623 nt, Artificial Sequence
  derived and/or modified sequence opt1 from VP1__Norovirus__BAJ13609
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaucaugaaccuggccagccugaacuggaacaacuacgaccccaccgaggagaucccggcgccccucgggacccccgacuucgugggcaagauccaggggguccugacgcagaccaccaagggcgacggguccacccggggccacaaggccacgguguacaccggcagcgcccccuucaccccgaagcuggggagcgugcaguucuccaccgacacggagaacgacuucgagacccaccagaacaccaaguucacccccgucggcgugauccaggacgggagcacgacccaccgcaacgagccccagcagugggugcuccccuccuacagcggccggaacguccacaacgugcaccuggccccggccguggcgcccaccuuccccggggagcagcuccucuucuuccgcuccaccaugcccggcugcagcggcuacccgaacauggaccuggacugccugcucccccaggaguggguccagcacuucuaccaggaggccgcccccgcccaguccgacguggcgcugcugcgguucgugaaccccgacacggggcgcguccucuucgagugcaagcugcacaagagcggcuacgugaccguggcccacaccgggcagcacgaccuggucaucccgcccaacggcuacuuccgguucgacuccugggugaaccaguucuacacccucacccccauggggaacggcacgggccgccggcgcgcccuguga

SEQ ID NO: 9909 - RNA, 1623 nt, Artificial Sequence
  derived and/or modified sequence opt1 from VP1__Norovirus__BAJ13612
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccagaacaccaaguucacgcccgucggggugauccaggacggcgggaccacccaccgcaacgagccccagcagugggugcuccccagcuacuccggccgggacguccacaacgugcaccuggccccggccguggcgcccaccuuccccggcgagcagcuccucuucuuccgcagcacgaugcccgggugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccaugggcaacgggacgggccgccggcgcgcccuguga

SEQ ID NO: 9910 - RNA, 1623 nt, Artificial Sequence
  derived and/or modified sequence opt1 from VP1__Norovirus__BAJ13615
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccgcaacgagccccagcagugggugcuccccuccuacagcggccggaacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcgcccuguga

SEQ ID NO: 9911 - RNA, 1623 nt, Artificial Sequence
  derived and/or modified sequence opt1 from VP1__Norovirus__BAJ13618
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacguccagaacgugcaccuggccccggccguggcgcccaccuuccccggggagcagcuccucuucuuccgcuccacgaugcccggcugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcgccggccgccggcgcgcccuguga

SEQ ID NO: 9912 - RNA, 1623 nt, Artificial Sequence; identical to SEQ ID NO: 9162
  derived and/or modified sequence opt1 from VP1__Norovirus__BAJ13621

SEQ ID NO: 9913 - RNA, 1623 nt, Artificial Sequence
  derived and/or modified sequence opt1 from VP1__Norovirus__BAJ13624
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgccgugcagccgcagaacgggcgcugcacgaccgacggcguccugcuggggaccacccagcucagccccgugaacaucugcacguuccggggcgacgucacccacaucgccggcucccgcaacuacaccaugaaccuggcgagccugaacuggaacaacuacgaccccaccgaggagaucccggcgccccucgggacgcccgacuucgugggcaagauccagggggugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggagcaccacccaccgcaacgagccccagcagugggugcuccccuccuacagcggccggaacgugccgaacguccaccuggcccccgccguggcccccaccuuccccggggagcagcuccucuucuuccgcuccacgaugccgggcugcagcggcuaccccaacauggaccuggacugccugcucccccaggagugggugcagcacuucuaccaggaggccgcccccgcgcaguccgacgucgcccugcugcgguucgugaacccggacaccgggcgcguccucuucgagugcaagcugcacaagagcggcuacgugaccguggcccacaccgggcagcacgaccuggugaucccgcccaacggcuacuuccgguucgacuccugggucaaccaguucuacacccucgcccccauggggaacggcacgggccgccggcgcgcccuguga

SEQ ID NO: 9914 - RNA, 1623 nt, Artificial Sequence
  derived and/or modified sequence opt1 from VP1__Norovirus__BAJ13627
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcgacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccacccccuucacgccgaagcugggcagcgugcaguucagcaccgacaccgagaacgacuucgagacccaccagaacacgaaguucacccccgucggggugauccaggacggcuccaccacccaccgcaacgagccccagcagugggugcuccccagcuacuccgggcggaacguccagaacgugcaccuggccccggccguggcccccacguuccccggcgagcagcuccucuucuuccgcagcaccaugcccggcugcuccggguacccgaacauggaccuggacugccugcucccccaggaguggguccagcacuucuaccaggaggcggcccccgcccagagcgacguggcccugcugcgguucgugaaccccgacaccggccgcguccucuucgagugcaagcugcacaaguccggguacgugaccguggcgcacaccggccagcacgaccuggucaucccgcccaacggguacuuccgguucgacagcugggugaaccaguucuacacgcucgcccccaugggcaacggcaccgggcgccggcgcgcccuguga

SEQ ID NO: 9915 - RNA, 1623 nt, Artificial Sequence
  derived and/or modified sequence opt1 from VP1__Norovirus__BAJ13630
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacgucccgaacgugcaccuggcccccgccguggcgcccaccuuccccggcgagcagcuccucuucuuccgcuccacgaugccgggcugcagcggguaccccaacauggaccuggacugccugcucccccaggaguggguccagcacuucuaccaggaggccgcccccgcccaguccgacguggcgcugcugcgguucgugaacccggacaccggccgcguccucuucgagugcaagcugcacaaggccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9916 - RNA, 1623 nt, Artificial Sequence
  derived and/or modified sequence opt1 from VP1__Norovirus__BAJ13633
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacacccgcuucacgcccgucggcgugauccaggacgggggcaccacccaccggaacgagccccagcagugggugcuccccagcuacuccgggcgcaacgucccgaacgugcaccuggcccccgccguggcgcccaccuuccccggcgagcagcuccucuucuuccggagcacgaugccgggcugcuccggguaccccaacauggaccuggacugccugcucccccaggaguggguccagcacuucuaccaggaggccgcccccgcccagagcgacguggcgcugcugcgcuucgugaacccggacaccggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcacggggcggcgccgcguguccuga

SEQ ID NO: 9917 - RNA, 1623 nt, Artificial Sequence; identical to SEQ ID NO: 9892
  derived and/or modified sequence opt1 from VP1__Norovirus__BAJ13636

SEQ ID NO: 9918 - RNA, 1623 nt, Artificial Sequence
  derived and/or modified sequence opt1 from VP1__Norovirus__BAJ13639
augaagauggccagcaacgacgccaaccccuccgacggcagcgcggccaaccuggugcaggaggucaacaacgaggugauggcccucgagccgguggucggggccgccaucgcggcccccguggccggccagcagaacgugaucgaccccuggauccgcaacaacuucguccaggcccccgggggcgaguucaccguguccccgcggaacgcgcccggggagauccuguggagcgcgccccugggccccgaccucaacccguaccugucccaccuggcccgcauguacaacggcuacgccgggggcuucgaggugcaggucauccucgccgggaacgccuucaccgccggcaagaucaucuucgccgccgugccgcccaacuuccccacggaggggcugagccccucccaggugaccauguucccccacaucaucgucgacgugcggcagcuggagcccgugcucaucccccugccggacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccucccccgacuucgacuucaucuuccucgugccgcccaccguggagagccgcaccaagcccuucacgguccccauccugaccguggaggagaugaccaacucccgguucccgaucccccuggagaagcuguucaccggccccagcuccgccuucgugguccagccccagaacgggcgcugcacgaccgacggcgugcugcuggggaccacccagcucagcccggucaacaucugcacguuccggggcgacgugacccacaucgccggcucccgcaacuacaucaugaaccuggccagccugaacuggaacaacuacgaccccaccgaggagauccccgcgccgcucgggacccccgacuucgugggcaagauccaggggguccugacgcagaccaccaagggcgacggguccacccggggccacaaggccacgguguacaccggcagcgcccccuucacccccaagcuggggagcgugcaguucuccaccgacacggagaacgacuucgagacccaccagaacaccaaguucaccccggucggcgugauccaggacgggagcacgacccaccgcaacgagccccagcagugggugcuccccuccuacagcggcgggaacguccacaacgugcaccuggcccccgccguggcgccgaccuuccccggcgagcagcuccucuucuuccgguccaccaugcccggcugcagcggguaccccaacauggaccuggacugccugcucccgcaggaguggguccagcacuucuaccaggaggccgcccccgcccaguccgacguggcgcugcugcgcuucgugaaccccgacacgggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcaccgggcggcgccgggcccuguga

SEQ ID NO: 9919 - RNA, 1623 nt, Artificial Sequence; identical to SEQ ID NO: 9892
  derived and/or modified sequence opt1 from VP1__Norovirus__BAJ13642

SEQ ID NO: 9920 - RNA, 1623 nt, Artificial Sequence
  derived and/or modified sequence opt1 from VP1__Norovirus__BAJ13648
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccgcaacgagccccagcagugggugcuccccuccuacagcggccgggacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcgcccuguga

SEQ ID NO: 9921 - RNA, 1623 nt, Artificial Sequence
  derived and/or modified sequence opt1 from VP1__Norovirus__BAJ13651
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccuccgagauccugugguccgcgccccuggggccggaccucaaccccuaccugagccaccuggcccgcauguacaacggcuacgccggcggguucgaggugcaggucauccucgccggcaacgccuucaccgccgggaagaucaucuucgccgccgugccgcccaacuucccgacggagggccugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggggaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacggccgcugcacgaccgacggggugcuccugggcaccacccagcucucccccgucaacaucugcacguuccgcggggacgugacccacaucgccggcagccggaacuacaccaugaaccuggccuccaucaacuggaacaacuacgaccccaccgaggagaucccggcgccccugggcacgcccgacuucguggggaagauccagggcguccucacccagaccaccaagggggacggcagcacgcgggggcacaaggccaccguguacaccggcagcgcccccuucaccccgaagcugggcuccgugcaguucagcacggacaccgagaacgacuucgagacccaccagaacaccaaguucacgcccgucggggugauccaggacggcgggaccacccaccagaacgagccccagcagugggugcugcccggcuacuccgggcgcaacgucccgaacgugcaccucgcccccgccguggcgcccaccuuccccggcgagcagcugcuguucuuccggagcacgaugccgggcugcuccggguaccccaacauggaccucgacugccugcugccccaggaguggguccagcacuucuaccaggaggccgcccccgcccagagcgacguggcgcuccugcgcuucgugaacccggacaccggccggguccuguucgagugcaagcuccacaaguccggguacgugaccguggcccacaccggccagcacgaccuggucaucccgcccaacggguacuuccgcuucgacagcugggugaaccaguucuacacccuggcccccaugggcaacggcacggggcggcgccgggcccucuga

SEQ ID NO: 9922 - RNA, 1623 nt, Artificial Sequence
  derived and/or modified sequence opt1 from VP1__Norovirus__BAJ13654
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccaucgagagccgcaccaagcccuucacggugcccauccugaccgucgaggagaugaccaacucccgguuccccaucccccuggagaagcuguucaccggccccagcggggccuucguggugcagccgcagaacggccgcugcacgaccgacgggguccugcugggcaccacccagcucucccccgugaacaucugcacguuccggggcgacgucacccacaucgccgggagccgcgacuacaccaugaaccuggccucccugaacuggaacaacuacgaccccaccgaggagaucccggcgccccucggcacgcccgacuucguggggaagauccagggcgugcugacccagaccaccaagggggacggcagcacgcggggccacaaggccaccgucuacaccggguccgcccccuucaccccgaagcugggcagcgugcaguucagcacggacaccgagaacgacuucgagacccaccagaacaccaaguucacgcccgugggggucauccaggacggcuccaccacccaccgcaacgagccccagcagugggugcuccccagcuacuccgggcggggcgugcacaacguccaccuggccccggccguggcgcccaccuuccccggcgagcagcuccucuucuuccgcagcacgaugcccgggugcuccggcuacccgaacauggaccuggacugccugcucccccaggagugggugcagcacuucuaccaggaggccgcccccgcccagagcgacgucgcgcugcugcgguucgugaaccccgacaccgggcgcguccucuucgagugcaagcugcacaaguccggcuacgugaccguggcccacaccgggcagcacgaccuggugaucccgcccaacggcuacuuccgguucgacagcugggucaaccaguucuacacccucgcccccaugggcaacgggacgggccgccggcgcgcccuguga

SEQ ID NO: 9923 - RNA, 1623 nt, Artificial Sequence
  derived and/or modified sequence opt1 from VP1__Norovirus__BAJ13657
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgccagccugggccccgaccucaacccguaccugucccaccuggcccgcauguacaacggcuacgccgggggcuucgaggugcaggucauccucgccgggaacgcguucaccgccggcaagaucaucuucgccgccgugccgcccaacuuccccacggaggggcugagcccgucccaggugaccauguucccccacaucaucgucgacgugcggcagcuggagcccgugcucaucccccugccggacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccucccccgacuucgacuucaucuuccucgugccgcccaccguggagagccgcaccaagcccuucacgguccccauccugaccguggaggagaugaccaacucccgguucccgaucccccuggagaagcuguucaccggccccagcuccgccuucgugguccagccccagaacgggcgcugcacgaccgacggcgugcugcuggggaccacccagcucagcccggucaacaucugcacguuccggggcgacgugacccacaucgccggcucccgcaacuacaccaugaaccuggccagccugaacuggaacaacuacgaccccaccgaggagauccccgcgccgcucgggacgcccgacuucgugggcaagauccaggggguccugacccagaccaccaagggcgacgggagcacgcggggccacaaggccaccguguacaccggcuccgcccccuucacccccaagcuggggagcgugcaguucuccacggacaccgagaacgacuucgagacccaccagaacaccaaguucacgccggucggcgugauccaggacgggggcaccacccaccgcaacgagccccagcagugggugcuccccagcuacuccgggcggaacguccagaacgugcaccuggcccccgccguggcgccgaccuuccccggcgagcagcuccucuucuuccgcagcacgaugcccggcugcuccggguaccccaacauggaccuggacugccugcucccgcaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9924 - RNA, 1623 nt, Artificial Sequence
  derived and/or modified sequence opt1 from VP1__Norovirus__BAJ13660
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccccugguccgccccgcugggccccgaccugaaccccuaccucucccaccuggcccgcauguacaacggcuacgccgggggcuucgaggugcaggucauccuggccgggaacgcguucaccgccggcaagaucaucuucgccgccgugcccccgaacuuccccacggaggggcucagccccucccaggugaccauguucccccacaucaucgucgacgugcggcagcuggagccggugcugaucccccuccccgacguccgcaacaacuucuaccacuacaaccagagcaacgacuccaccaucaagcugaucgccaugcuguacacgccccuccgggcgaacaacgccggcgaggacguguucaccgugagcugccgcguccugacccggccgucccccgacuucgacuucaucuuccuggugccgcccaccguggagagccgcaccaagccguucacgguccccauccucaccguggaggagaugaccaacucccgguuccccaucccccuggagaagcuguucaccggcccgagcuccgccuucgugguccagccccagaacgggcgcugcacgaccgacggcgugcuccuggggaccacccagcugagccccgucaacaucugcacguuccggggcgacgugacccacaucgccggcucccgcgacuacaccaugaaccucgccagccugaacuggaacaacuacgacccgaccgaggagauccccgcgccccuggggacgcccgacuucgugggcaagauccaggggguccucacccagaccaccaagggcgacggguccacgcggggccacaaggccaccguguacaccggcagcgccccguucacccccaagcuggggagcgugcgcuucuccacggacaccgagaacgacuucgagacccaccagaacaccaaguucacgcccgucggcgugauccaggacgggagcaccacccaccggaacgagccccagcagugggugcugccguccuacagcggccgcgacguccacaacgugcaccucgcccccgccguggcgcccaccuuccccggggagcagcugcuguucuuccgguccacgaugccgggcugcagcggcuaccccaacauggaccucgacugccugcugccccaggaguggguccagcacuucuaccaggaggccgcccccgcccaguccgacguggcgcuccugcgcuucgugaacccggacaccgggcggguccuguucgagugcaagcuccacaagagcggcuacgugaccguggcccacaccgggcagcacgaccuggucaucccgcccaacggcuacuuccgcuucgacuccugggugaaccaguucuacacccuggcccccauggggaacggcacgggccggcgccgcgcccucuga

SEQ ID NO: 9925 - RNA, 1623 nt, Artificial Sequence
  derived and/or modified sequence opt1 from VP1__Norovirus__BAJ13663
augaagauggccagcaacgacgccaaccccuccgacggcagcgcggccaaccuggugccggaggucaacaacgaggggauggcccucgagcccguggugggcgccgccaucgcggcccccgucgccgggcagaccaacgugaucgaccccuggauccgcaacaacuucgugcaggccccgggcggggaguucaccgucagcccccggaacgcgcccuccgagauccugugguccgccagccugggccccgaccucaacccguaccugucccaccuggcccgcauguacaacggcuacgccgggggcuucgagguccaggugauccucgccgggaacgcguucacggccggcaagaucaucuucgccgccgugccgcccaacuuccccaccgaggggcugagccccucccaggugaccauguucccccacaucaucguggacguccggcagcuggagcccgugcucaucccccugccggacgugcgcaacaacuucuaccacuacaaccagagcaacgacuccaccaucaagcugaucgccaugcucuacacgccccugcgggcgaacaacgccggcgaggacgucuucaccgugagcugccgcgugcugacccggcccucccccgacuucgacuucaucuuccucgucccgcccaccguggagagccgcacgaagcccuucaccgugcccauccugaccgucgaggagaugaccaacucccgguucccgaucccccuggagaagcuguucacgggccccagcggggccuucguggugcagccccagaacggccgcugcaccaccgacgggguccugcugggcaccacgcagcucuccccggugaacaucugcaccuuccggggcgacgucacccacaucgccgggagccgcaacuacaccaugaaccuggccucccugaacuggaacaacuacgaccccacggaggagauccccgcgccgcucggcacccccgacuucguggggaagauccagggcgugcugacccagaccacgaaggggaacggcagcacccggggccacaaggccaccgucuacaccgggagcgcccccuucacgcccaagcugggcuccgugcaguucagcaccgacaccgagaacgacuucgagacccaccagaacacgaaguucaccccggugggggucauccaggacggcuccaccacccaccgcaacgagccccagcagugggugcuccccagcuacuccgggcggagcgugcacaacguccaccuggcccccgccguggcgccgacguuccccggcgagcagcuccucuucuuccgcuccaccaugcccggcugcagcggguaccccaacauggaccuggacugccugcucccgcaggagugggugcagcacuucuaccaggaggccgcccccgcccaguccgacgucgcgcugcugcgguucgugaaccccgacaccggccgcguccucuucgagugcaagcugcacaagagcggguacgugaccguggcccacaccggccagcacgaccuggugaucccgcccaacggguacuuccgguucgacuccugggucaaccaguucuacacgcucgcccccaugggcaacggcaccgggcgccggcgcgcccuguga

SEQ ID NO: 9926 - RNA, 1623 nt, Artificial Sequence
  derived and/or modified sequence opt1 from VP1__Norovirus__BAJ13666
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacaucacccacaucgccggcucccgcaacuacaccaugaaccuggccagccugaacuggaacaacuacgaccccaccgaggagaucccggcgccccucgggacgcccgacuucgugggcaagauccagggggugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggagcaccacccaccgcaacgagccccagcagugggugcuccccuccuacagcggccggaacgcccacaacgugcaccuggccccggcggucgcccccaccuuccccggggagcagcuccucuucuuccgcuccacgaugcccggcugcagcggcuacccgaacauggaccuggacugccugcucccccaggagugggugcagcacuucuaccaggaggccgcccccgcgcaguccgacguggcccugcugcgguucgucaaccccgacaccgggcgcguccucuucgagugcaagcugcacaagagcggcuacgugaccguggcccacaccgggcagcacgaccuggugaucccgcccaacggcuacuuccgguucgacuccugggugaaccaguucuacacccucgcccccauggggaacggcacgggccgccggcgcgcccuguga

SEQ ID NO: 9927 - RNA, 1623 nt, Artificial Sequence
  derived and/or modified sequence opt1 from VP1__Norovirus__BAJ13669
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucggcacggacaccgagaacgacuucgagacccaccagaacaccaaguucacgccggucggggugauccaggacggcuccaccacccaccgcaacgagccccagcagugggugcuccccagcuacuccgggcggaacguccacaacgugcaccuggcccccgccguggcgccgaacuuccccggcgagcagcuccucuucuuccgcagcaccaugcccggcugcuccggguaccccaacauggaccuggacugccugcucccgcaggaguggguccagcacuucuaccaggaggccgcccccgcccagagcgacguggcgcugcugcgguucgugaaccccgacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggcgccggcgcgcccuguga

SEQ ID NO: 9928 - RNA, 1623 nt, Artificial Sequence
  derived and/or modified sequence opt1 from VP1__Norovirus__BAJ13672
augaagauggccagcaacgacgccaaccgcuccgacggcagcgcggccaaccuggugcccgaggucaacaacgaggugauggcccucgagccgguggucggggccgccaucgcggcccccguggccggccagcagaacgugaucgaccccuggauccggaacaacuucguccaggcccccgggggcgaguucaccguguccccgcgcaacgcgcccggggagauccuguggagcgcgccccugggccccgaccucaacccguaccugucccaccuggcccggauguacaacggcuacgccgggggcuucgaggugcaggucauccucgccgggaacgccuucaccgccggcaagaucaucuucgccgccgugccgcccaacuuccccacggaggggcugagccccucccaggugaccauguucccccacaucaucgucgacgugcgccagcuggagcccgugcucaucccccugccggacguccggaacaacuucuaccacuacaaccagagcaacgacuccaccaucaagcugaucgccaugcucuacacgccccugcgcgcgaacaacgccggcgaggacguguucaccgugagcugccggguccugacccgccccucccccgacuucgacuucaucuuccucgugccgcccaccguggagagccggaccaagcccuucacgguccccauccugaccguggaggagaugaccaacucccgcuucccgaucccccuggagaagcuguucaccggccccagcuccgccuucgugguccagccccagaacgggcggugcacgaccgacggcgugcugcuggggaccacccagcucagcccggucaacaucugcacguuccgcggcgacgugacccacaucgccggcucccggaacuacaccaugaaccuggccagccugaacuggaacaacuacgaccccaccgaggagauccccgcgccgcucgggacgcccgacuucgugggcaagauccaggggguccugacccagaccaccaagggcgacggguccacgcgcggccacaaggccaccguguacaccggcagcgcccccuucacccccaagcuggggagcgugcaguucuccacggacaccgagaacgacuucgagacccaccagaacaccaaguucacgccggucggcgugauccaggacgggagcaccacccaccgguccgagccccagcagugggugcuccccagcuacuccggccgcaacguccccaacgugcaccuggccccggccguggcgcccaccuuccccggggagcagcuccucuucuuccggagcacgaugcccggcugcuccggcuacccgaacauggaccuggacugccugcucccccaggaguggguccagcacuucuaccaggaggccgcccccgcccagagcgacguggcgcugcugcgcuucgugaaccccgacaccgggcggguccucuucgagugcaagcugcacaaguccggcuacgugaccguggcccacaccgggcagcacgaccuggucaucccgcccaacggcuacuuccgcuucgacagcugggugaaccaguucuacacccucgcccccauggggaacggcacgggccggcgccgcgcccuguga

SEQ ID NO: 9929 - RNA, 1623 nt, Artificial Sequence
  derived and/or modified sequence opt1 from VP1__Norovirus__BAJ13675
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacagcuacgccggcggguucgaggugcaggucauccucgccggcaacgccuucaccgccgggaagaucaucuucgccgccgugccgcccaacuucccgacggagggccugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggggaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacggccgcugcacgaccgacggggugcugcugggcaccacccagcucucccccgucaacaucugcacguuccgcggggacgugacccacaucgccggcagccggaacuacaccaugaaccuggccucccugaacuggaacaacuacgaccccaccgaggagaucccggcgccccucggcacgcccgacuucguggggaagauccagggcguccugacccagaccaccaagggggacggcagcacgcgggggcacaaggccaccguguacaccggcagcgcccccuucaccccgaagcugggcuccgugcaguucagcacggacaccgagaacgacuucgagacccaccagaacaccaaguucacgcccgucggggugauccaggacggcgggaccacccaccgcaacgagccccagcagugggugcuccccuccuacagcggccgggacguccacaacgugcaccuggccccggccguggcgcccaccuuccccggggagcagcuccucuucuuccgcuccacgaugcccggcugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcgcccuguga

SEQ ID NO: 9930 - RNA, 1623 nt, Artificial Sequence
  derived and/or modified sequence opt1 from VP1__Norovirus__BAJ13678
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcgacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgaggcccaccagaacaccaaguucacgcccgucggggugauccaggacggcuccaccacccaccgcaacgagccccagcagugggugcuccccagcuacuccgggcggaacguccagaacgugcaccuggccccggcgguggcccccaccuuccccggcgagcagcuccucuucuuccgcagcacgaugcccggcugcuccggguacccgaacauggaccuggacugccugcucccccaggaguggguccagcacuucuaccaggaggccgcccccgcgcagagcgacguggcccugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9931 - RNA, 1623 nt, Artificial Sequence
  derived and/or modified sequence opt1 from VP1__Norovirus__BAJ13681
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccaggacaccaaguucacgcccgucggcgugauccaggacgggggcaccacccaccgcaacgagccccagcagugggugcuccccuccuacagcgggcggaacguccagaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 9932 - RNA, 1623 nt, Artificial Sequence
  derived and/or modified sequence opt1 from VP1__Norovirus__BAJ13684
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggugucccugaacuggaacaacuacgaccccaccgaggagaucccggcgccccucgggacgcccgacuucgucggcaagauccagggggugcugacccagaccaccaagggcgacgggagcacgcggggccacaaggccaccguguacaccggcagcgcccccuucaccccgaagcugggguccguccaguucagcacggacaccgagaacgacuucgagacccaccagaacaccaaguucacgcccgugggcgugauccaggacggguccaccacccaccgcaacgagccccagcaguggguccuccccagcuacuccggccggaacgugcacaacgugcaccuggccccggccgucgcccccaccuuccccggggagcagcuccucuucuuccgcagcacgaugcccggcugcuccggcuacccgaacauggaccuggacugccugcucccccaggagugggugcagcacuucuaccaggaggcggcccccgcccagagcgacguggcccugcugcgguucgucaaccccgacaccgggcgcguccucuucgagugcaagcugcacaaguccggcuacgugaccguggcguacaccgggcagcacgaccuggugaucccgcccaacggcuacuuccgguucgacagcugggugaaccaguucuacacccucgcccccauggggaacggcacgggccgccggcgcgcccuguga

SEQ ID NO: 9933 - RNA, 1623 nt, Artificial Sequence
  derived and/or modified sequence opt1 from VP1__Norovirus__BAJ13687
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucaucgugcagccgcagaacgggcgcugcacgaccgacggcguccugcuggggaccacccagcucagccccgugaacaucugcacguuccggggcgacgucacccacaucgccggcucccgcaacuacaccaugaaccuggccagccugaacuggaacaacuacgaccccaccgaggagaucccggcgccccucgggacgcccgacuucgugggcaagauccagggggugcugacccagaccaccaagggcgacggguccacgcggggccacaaggccaccgucuacaccggcagcgccgacuucacccccaagcuggggagcgugcaguucggcacggacaccgagaacgacuucgagacccaccagaacaccaaguucacgccggugggggucauccaggacggcuccaccacccaccgcaacgagccccagcagugggugcuccccagcuacuccgggcggaacgugcacaacguccaccuggcccccgccguggcgccgaacuuccccggcgagcagcuccucuucuuccgcagcaccaugcccggcugcuccggguaccccaacauggaccuggacugccugcucccgcaggagugggugcagcacuucuaccaggaggccgcccccgcccagagcgacgucgcgcugcugcgguucgugaaccccgacacgggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcaccgggcgccggcgcgcccuguga

SEQ ID NO: 9934 - RNA, 1623 nt, Artificial Sequence
  derived and/or modified sequence opt1 from VP1__Norovirus__BAJ13690
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacguccacaacgugcaccuggccccggccguggcgcccaccuuccccggggagcagcuccucuucuuccgcuccacgaugcccggcugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcgcccuguga

SEQ ID NO: 9935 - RNA, 1623 nt, Artificial Sequence
  derived and/or modified sequence opt1 from VP1__Norovirus__BAJ13693
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucgucaaggcccccgggggcgaguucaccgugagcccccggaacucccccggggagauccugugguccgcgccccugggcccggaccucaaccccuaccugagccaccuggcccgcauguacaacggcuacgccgggggcuucgaggugcaggucauccucgccgggaacgccuucaccgcgggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucaucgugcagccgcagaacgggcgcugcacgaccgacggcguccugcuggggaccacccagcucucccccgugaacaucugcacguuccggggcgacgucacccacaucgccggcagccgcaacuacaccaugaaccuggccucccugaacuggaacaacuacgaccccaccgaggaggugccggcgccccucgggacgcccgacuucgugggcaagauccaggggguccugacccagaccaccaagggcgacgggagcacgcggggccacaaggccaccguguacaccggcagcgccgacuucacccccaagcugggguccgugcaguucggcacggacaccgagaacgacuucgagacccaccagaacaccaaguucacgccggucggggugauccaggacggcagcaccacccaccgcaacgagccccagcagugggugcuccccuccuacagcgggcggaacguccacaacgugcaccuggcccccgccguggccccgaacuuccccggcgagcagcuccucuucuuccgcuccaccaugcccggcugcagcggguaccccaacauggaccuggacugccugcucccgcaggaguggguccagcacuucuaccaggaggcggcccccgcccaguccgacguggcccugcugcgguucgugaaccccgacacgggccgcguccucuucgagugcaagcugcacaagagcggguacgugaccguggcgcacaccggccagcacgaccuggucaucccgcccaacggguacuuccgguucgacuccugggugaaccaguucuacacccucgcccccaugggcaacggcaccgggcgccggcgcgcccuguga

SEQ ID NO: 9936 - RNA, 1623 nt, Artificial Sequence
  derived and/or modified sequence opt1 from VP1__Norovirus__BAJ13696
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacacccgcuucacgcccgucggcgugauccaggacgggggcaccacccaccggaacgagccccagcagugggugcuccccagcuacuccgggcgcaacgucccgaacgugcaccuggcccccgccguggcgcccaccuuccccggcgagcagcuccucuucuuccggagcacgaugccgggcugcuccggguaccccaacauggaccuggacugccugcucccccaggaguggguccagcacuucuaccaggaggccgcccccgcccagagcgacguggcgcugcugcgcuucgugaacccggacaccggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcacggggcggcgccgcgugcuguga

SEQ ID NO: 9937 - RNA, 1623 nt, Artificial Sequence
  derived and/or modified sequence opt1 from VP1__Norovirus__BAJ13699
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccgcgcugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgccgacuucacccccaagcugggcuccgugcaguucagcacggacaccgagaacgacuucgagacccaccagaacaccaaguucacgccggucggggugauccaggacggcagcaccacccaccgcaacgagccccagcagugggugcuccccuccuacagcgggcggaacguccacaacgugcaccuggcccccgccguggccccgaccuuccccggcgagcagcuccucuucuuccgcuccacgaugcccggcugcagcggguaccccaacauggaccuggacugccugaucccgcaggaguggguccagcacuucuaccaggaggccgcccccgcgcaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacggcgccgggcgccggcgcgcgcucuga

SEQ ID NO: 9938 - RNA, 1623 nt, Artificial Sequence
  derived and/or modified sequence opt1 from VP1__Norovirus__BAJ13702
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgaggcccaccagaacaccaaguucacgcccgucggggugauccaggacggcuccaccacccaccgcaacgagccccagcagugggugcuccccagcuacuccgggcggaacgcccagaacguccaccuggcgccggccguggcccccaccuuccccggcgagcagcuccucuucuuccgcagcacgaugcccggcugcuccggguacccgaacauggaccuggacugccugcucccccaggagugggugcagcacuucuaccaggaggccgcgcccgcccagagcgacgucgcccugcugcgguucgugaaccccgacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcacggggcgccggcgcgcgcuguga

SEQ ID NO: 9939 - RNA, 1623 nt, Artificial Sequence
  derived and/or modified sequence opt1 from VP1__Norovirus__BAJ13711
augaagauggccagcaacgacgccaaccccuccgacggcagcgcggccaaccuggugcccgaggucaacaacgaggugauggcccucgagcccguggucggggccgccaucgcggcccccguggccgcccagcagaacgugaucgaccccuggauccgcaacaacuucguccaggcgccgggcggggaguucaccgugagcccccggaacgcccccuccgagauccugugguccgcgccccugggcccggaccucaaccccuaccugagccacuucgcccgcauguacaacugcuacgccgggggcuucgaggugcaggucauccuggccggcaacgccuucaccgccgggaagaucaucuucgccgccgugccgcccaacuuccccacggagggccucucccccagccaggugaccauguucccccacaucaucgucgacgugcggcagcuggagcccgugcugaucccgcuccccgacguccgcaacaacuucuaccacuacaaccaguccaacgacagcaccaucaagcugaucgcgaugcuguacacgccccuccgggccaacaacgccggggaggacguguucaccguguccugccgcguccugacccggcccagcccggacuucgacuucaucuuccuggugccgcccaccguggagucccgcaccaagcccuucacgguccccauccucaccguggaggagaugaccaacagccgguuccccaucccccuggagaagcuguucaccggccccuccagcgccuucgugguccagccgcagaacgggcgcugcacgaccgacggcgugcuccugggcaccacccagcugucccccgucaacaucugcacguuccgcggggacgugacccacaucgccggcagccggaacuacaccaugaaccucgcgucccugaacuggaacaacuacgaccccaccgaggagaucccggcgccccuggggacgcccgacuucgugggcaagauccagggcguccucacccagaccaccaagggggacggcagcacgcgggggcacaaggccaccguguacaccggcagcgcccccuucaccccgaagcugggguccgugcaguucagcacggacaccgagaacgacuucgagacccaccagaacaccaaguucacgcccgucggcgugauccaggacggcgggaccacccaccgcaacgagccccagcagugggugcugcccuccuacagcggccggaacgucccgaacgugcaccucgcccccgccguggcccccaccuuccccggggagcagcugcuguucuuccgcuccacgaugccgggcugcagcggguaccccaacauggaccucgacugccugcugccccaggaguggguccagcacuucuaccaggaggccgcccccgcgcaguccgacguggcccuccugcgguucgugaacccggacaccggccgcguccuguucgagugcaagcuccacaagagcggcuacgugaccguggcccacaccgggcagcacgaccuggucaucccgcccaacggcuacuuccgguucgacuccugggugaaccaguucuacacccuggcccccauggggaacggcacggggcgccggcgcgcccucuga

SEQ ID NO: 9940 - RNA, 1623 nt, Artificial Sequence; identical to SEQ ID NO: 9904
  derived and/or modified sequence opt1 from VP1__Norovirus__BAJ13714

SEQ ID NO: 9941 - RNA, 1623 nt, Artificial Sequence
  derived and/or modified sequence opt1 from VP1__Norovirus__BAJ13717
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacguggccggcucccgcaacuacaucaugaaccuggccagccugaacuggaacaacuacgaccccaccgaggagaucccggcgccccucgggacccccgacuucgucggcaagauccagggggugcugacgcagaccaccaagggcgacggguccacccggggccacaaggccacgguguacaccggcagcgcccccuucaccccgaagcuggggagcguccaguucuccaccgacacggagaacgacuucgagacccaccagaacaccaaguucacccccgugggcgugauccaggacgggagcacgacccaccgcaacgagccccagcaguggguccuccccuccuacagcggccggaacgugcacaacgugcaccuggccccggccgucgcgcccaccuuccccggggagcagcuccucuucuuccgcuccaccaugcccggcugcagcggcuacccgaacauggaccuggacugccugcucccccaggagugggugcagcacuucuaccaggaggccgcccccgcccaguccgacguggcgcugcugcgguucgucaaccccgacacggggcgcguccucuucgagugcaagcugcacaagagcggcuacgugaccguggcccacaccgggcagcacgaccuggugaucccgcccaacggcuacuuccgguucgacuccugggugaaccaguucuacacccucgcccccauggggaacggcaccggccgccggcgcgcccuguga

SEQ ID NO: 9942 - RNA, 1623 nt, Artificial Sequence
  derived and/or modified sequence opt1 from VP1__Norovirus__BAJ13720
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacgugugcacguuccggggcgacgugacccacaucgccggcucccgcaacuacaccaugaaccuggccagccugaacuggaacaacuacgaccccaccgaggagaucccggcgccccucgggacgcccgacuucgucggcaagauccagggggugcugacccagaccaccaagggcgacggguccacgcggggccacaaggccaccguguacaccggcagcgcccccuucaccccgaagcuggggagcguccaguucuccacggacaccgagaacgacuucgagacccaccagaacaccaaguucacgcccgugggcgugauccaggacgggggcaccacccaccgcaacgagccccagcaguggguccuccccagcuacuccgggcgggacgugccgaacgugcaccuggcccccgccgucgcgcccaccuuccccggcgagcagcuccucuucuuccgcagcacgaugccgggcugcuccggguaccccaacauggaccuggacugccugcucccccaggagugggugcagcacuucuaccaggaggccgcccccgcccagagcgacguggcgcugcugcgguucgucaacccggacaccggccgcguccucuucgagugcaagcugcacaaguccggguacgugaccguggcccacaccggccagcacgaccuggugaucccgcccaacggguacuuccgguucgacagcugggugaaccaguucuacacccucgcccccaugggcaacggcacggggcgccggcgcgcccuguga

SEQ ID NO: 9943 - RNA, 1623 nt, Artificial Sequence
  derived and/or modified sequence opt1 from VP1__Norovirus__BAJ13723
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccgugcugaccguggaggagaugaccaacucccgguuccccaucccccuggagaagcuguucaccggccccagcuccgccuucgucgugcagccgcagaacgggcgcugcacgaccgacggcguccugcuggggaccacccagcucagccccgugaacaucugcacguuccggggcgacgugacccacaucgccggcucccgcgacuacaccaugaaccuggccagccugaacuggaacaacuacgaccccaccgaggagaucccggcgccccucgggacgcccgacuucgucggcaagauccagggggugcugacccagaccacccggggcgacggguccacgcgcggccacaaggccaccguguacaccggcagcgcccccuucaccccgaagcuggggagcguccaguucuccacggacaccgagaacgacuucgagacccaccagaacaccaaguucacgcccgugggcgugauccaggacgggggcaccacccaccggaacgagccccagcaguggguccuccccagcuacuccgggcgcaacgugccgaacgugcaccuggcccccgccgucgcgcccaccuuccccggcgagcagcuccucuucuuccggagcacgaugccgggcugcuccggguaccccaacauggaccuggacugccugcucccccaggagugggugcagcacuucuaccaggaggccgcccccgcccagagcgacguggcgcugcugcgcuucgucaacccggacaccggccggguccucuucgagugcaagcugcacaaguccggguacgugaccguggcccacaccggccagcacgaccuggugaucccgcccaacggguacuuccgcuucgacagcugggugaaccaguucuacacccucgcccccaugggcaacggcacggggcggcgccgcgcccuguga

SEQ ID NO: 9944 - RNA, 1623 nt, Artificial Sequence
  derived and/or modified sequence opt1 from VP1__Norovirus__BAJ13726
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9945 - RNA, 1623 nt, Artificial Sequence; identical to SEQ ID NO: 9904
  derived and/or modified sequence opt1 from VP1__Norovirus__BAJ13729

SEQ ID NO: 9946 - RNA, 1623 nt, Artificial Sequence; identical to SEQ ID NO: 9855
  derived and/or modified sequence opt1 from VP1__Norovirus__BAJ13732

SEQ ID NO: 9947 - RNA, 1623 nt, Artificial Sequence; identical to SEQ ID NO: 9162
  derived and/or modified sequence opt1 from VP1__Norovirus__BAJ13738

SEQ ID NO: 9948 - RNA, 1623 nt, Artificial Sequence
  derived and/or modified sequence opt1 from VP1__Norovirus__BAJ13741
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccaguacgaccuggucaucccgcccaacggguacuuccgguucgacagcugggugaaccaguucuacacccucgcccccaugggcaacggcacggggcgccggcgcgcccuguga

SEQ ID NO: 9949 - RNA, 1623 nt, Artificial Sequence; identical to SEQ ID NO: 9892
  derived and/or modified sequence opt1 from VP1__Norovirus__BAJ13744

SEQ ID NO: 9950 - RNA, 1623 nt, Artificial Sequence; identical to SEQ ID NO: 9382
  derived and/or modified sequence opt1 from VP1__Norovirus__BAJ13747

SEQ ID NO: 9951 - RNA, 1623 nt, Artificial Sequence; identical to SEQ ID NO: 9441
  derived and/or modified sequence opt1 from VP1__Norovirus__BAJ13750

SEQ ID NO: 9952 - RNA, 1623 nt, Artificial Sequence; identical to SEQ ID NO: 9382
  derived and/or modified sequence opt1 from VP1__Norovirus__BAJ13753

SEQ ID NO: 9953 - RNA, 1623 nt, Artificial Sequence
  derived and/or modified sequence opt1 from VP1__Norovirus__BAJ13756
augaagauggccagcuccgacgccaacccgcccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgccccgcugggccccgaccucaaccccuaccugucccaccuggcccgcauguacaacggcuacgccgggggcuucgaggugcaggucauccucgccgggaacgcguucaccgccggcaagaucaucuucgccgccgugcccccgaacuuccccacggaggggcugagccccucccaggugaccauguucccccacaucaucgucgacgugcggcagcuggagccggugcucaucccccugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggccgucccccgacuucgacuucaucuuccucgugccgcccaccguggagagccgcaccaagcccuucacgguccccauccugaccguggaggagaugaccaacucccgguuccccaucccccuggagaagcuguucaccggcccgagcggggccuucgugguccagccccagaacggccgcugcacgaccgacggggugcugcugggcaccacccagcucucccccgucaacaucugcacguuccggggcgacgugacccacaucgccgggagccgcuccuacaccaugaaccuggccagccugaacuggaacaacuacgacccgaccgaggagauccccgcgccccucggcacgcccgacuucguggggaagauccagggcaugcugacccagaccaccaagggggacggcuccacgcggggccacaaggccaccgucuacaccgggagcgccccguucacccccaagcugggcagcgugcaguucuccacggacaccgagaacgacuuccagacccaccagaacaccaaguucacgcccgugggggucauccaggacggcagcaccacccaccgcaacgagccccagcagugggugcucccguccuacagcgggcgggacgugcacaacguccaccuggcccccgccguggcgcccaccuuccccggcgagcagcuccucuucuuccgcuccacgaugccgggcugcagcggguaccccaacauggaccuggacugccugcucccccaggagugggugcagcacuucuaccaggaggccgcccccgcccaguccgacgucgcgcugcugcgguucgugaacccggacaccggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacggcacggggcgccggcgcgcccuguga

SEQ ID NO: 9954 - RNA, 1623 nt, Artificial Sequence
  derived and/or modified sequence opt1 from VP1__Norovirus__BAJ13759
augaagauggccagcaacgacgccaaccccuccgacggcagcgcggccucccuggugccggaggucagcaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccgggagcgcccccuucaccccgaagcugggcuccgugcaguucagcacggacaccgagaacgacuucgagacccaccagaacaccaaguucacgcccgucggggugauccaggacggcuccaccacccaccgcaacgagccccagcagugggugcuccccagcuacuccgggcgggacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9955 - RNA, 1623 nt, Artificial Sequence; identical to SEQ ID NO: 9441
  derived and/or modified sequence opt1 from VP1__Norovirus__BAJ13762

SEQ ID NO: 9956 - RNA, 1623 nt, Artificial Sequence; identical to SEQ ID NO: 9441
  derived and/or modified sequence opt1 from VP1__Norovirus__BAJ13765

SEQ ID NO: 9957 - RNA, 1623 nt, Artificial Sequence; identical to SEQ ID NO: 9944
  derived and/or modified sequence opt1 from VP1__Norovirus__BAJ13768

SEQ ID NO: 9958 - RNA, 1623 nt, Artificial Sequence
  derived and/or modified sequence opt1 from VP1__Norovirus__BAJ13771
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgccgcccugggccccgaccucaacccguaccugucccaccuggcccgcauguacaacggcuacgccgggggcuucgaggugcaggucauccucgcggggaacgccuucacggccggcaagaucaucuucgccgccgugccgcccaacuuccccaccgaggggcugagcccgucccaggugaccauguucccccacaucaucgucgacgugcggcagcuggagcccgugcucaucccccugccggacguccgcaacaacuucuaccacuacaaccagagcaacgacuccaccaucaagcugaucgcgaugcucuacacgccccugcgggccaacaacgccggcgaggacguguucaccgugagcugccgcguccugacccggcccucccccgacuucgacuucaucuuccucgugccgcccaccguggagagccgcacgaagcccuucaccguccccauccugaccguggaggagaugaccaacucccgguucccgaucccccuggagaagcuguucacgggccccagcggggccuucgugguccagccccagaacggccgcugcaccaccgacggggugcugcugggcaccacgcagcucuccccggucaacaucugcaccuuccggggcgacgugacccacaucgccgggagccgcaacuacaccaugaaccuggcgucccugaacuggaacaacuacgaccccacggaggagauccccgccccgcucggcacccccgacuucguggggaagauccagggcguccugacccagaccacgaagggggacggcagcacccggggccacaaggccaccguguacaccggguccgcccccuucacgcccaagcugggcagcgugcaguucagcaccgacaccgagaacgacuucgagacccaccagaacacgaaguucaccccggucggggugauccaggacggcuccaccacccaccgcaacgagccccagcagugggugcuccccagcuacuccgggcggaacguccacaacgugcaccuggcccccgcgguggccccgacguuccccggcgagcagcuccucuucuuccgcagcaccaugcccggcugcuccggguaccccaacauggaccuggacugccugcucccgcaggaguggguccagcacuucuaccaggaggccgcccccgcgcagagcgacguggcccugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacgcucgcccccaugggcaacggcaccgggcgccggcgcgcccuguga

SEQ ID NO: 9959 - RNA, 1623 nt, Artificial Sequence; identical to SEQ ID NO: 9892
  derived and/or modified sequence opt1 from VP1__Norovirus__BAJ13774

SEQ ID NO: 9960 - RNA, 1623 nt, Artificial Sequence
  derived and/or modified sequence opt1 from VP1__Norovirus__BAJ13777
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgaggcccaccagaacaccaaguucacgcccgucggggugauccaggacggcuccaccacccaccgcaacgagccccagcagugggugcuccccagcuacuccgggcggaacguccagaacgugcaccuggccccggcgguggcccccaccuuccccggcgagcagcuccucuucuuccgcagcacgaugcccggcugcuccggguacccgaacauggaccuggacugccugcucccccaggaguggguccagcacuucuaccaggaggccgcccccgcgcagagcgacguggcccugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9961 - RNA, 1623 nt, Artificial Sequence; identical to SEQ ID NO: 9892
  derived and/or modified sequence opt1 from VP1__Norovirus__BAJ13780

SEQ ID NO: 9962 - RNA, 1623 nt, Artificial Sequence; identical to SEQ ID NO: 9892
  derived and/or modified sequence opt1 from VP1__Norovirus__BAJ13783

SEQ ID NO: 9963 - RNA, 1623 nt, Artificial Sequence; identical to SEQ ID NO: 9441
  derived and/or modified sequence opt1 from VP1__Norovirus__BAJ13786

SEQ ID NO: 9964 - RNA, 1623 nt, Artificial Sequence
  derived and/or modified sequence opt1 from VP1__Norovirus__BAJ13792
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucgugcucgccgggaacgccuucaccgccggcaaggugaucuucgccgccgucccgcccaacuucccgacggaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgccaugcucuacacgccccugcgggcgaacaacgccggcgaggacgucuucaccgugagcugccgcgugcugacccggcccuccccggacuucgacuucaucuuccucgucccgcccaccguggagagccgcaccaagcccuucacggugcccauccugaccgucgaggagaugaccaacucccgguuccccaucccccuggagaagcuguucaccggccccagcggggccuucgugguccagccgcagaacggccgcugcacgaccgacggggugcugcugggcaccacccagcucucccccgugaacaucugcacguuccggggcgacgucacccacaucgccgggagccgcaacuacaccaugaaccuggccucccugaacuggaacaacuacgaccccaccgaggagaucccggcgccccucggcacgcccgacuucguggggaagauccagggcgugcugacccagaccaccaagggggacggcagcacgcggggccacaaggccaccgucuacaccggguccacccccuucacgccgaagcugggcagcgugcaguucagcaccgacaccgagaacgacuucgagaaccaccagaacaccaaguucacgcccgugggggucauccaggacggcgggaccacccaccgcaacgagccccagcagugggugcuccccuccuacagcggccggaacgugcagaacguccaccuggccccggccguggcccccaccuuccccggcgagcagcuccucuucuuccgcuccacgaugcccgggugcagcggcuacccgaacauggaccuggacugccugcucccccaggagugggugcagcacuucuaccaggaggcggcccccgcccaguccgacgucgcccugcugcgguucgugaaccccgacaccgggcgcguccucuucgagugcaagcugcacaagagcggcuacgugaccguggcgcacaccgggcagcacgaccuggugaucccgcccaacggcuacuuccgguucgacuccugggucaaccaguucuacacccucgcccccaugggcaacgggacgggccgccggcgcgcccuguga

SEQ ID NO: 9965 - RNA, 1623 nt, Artificial Sequence
  derived and/or modified sequence opt1 from VP1__Norovirus__BAJ13795
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccccugguccgccccgcugggccccgaccugaaccccuaccucucccaccuggcccgcauguacaacggcuacgccgggggcuucgaggugcaggucgugcuggccgggaacgcguucaccgccggcaaggugaucuucgccgccgugcccccgaacuuccccacggaggggcucagccccucccaggucaccauguucccccacaucaucguggacguccggcagcuggagccggugcugaucccccuccccgacgugcgcaacaacuucuaccacuacaaccagagcaacgacuccaccaucaagcugaucgccaugcuguacacgccccuccgggcgaacaacgccggcgaggacgucuucaccgugagcugccgcgugcugacccggccgucccccgacuucgacuucaucuuccuggucccgcccaccguggagagccgcaccaagccguucacggugcccauccucaccgucgaggagaugaccaacucccgguuccccaucccccuggagaagcuguucaccggcccgagcggggccuucgugguccagccccagaacggccgcugcacgaccgacggggugcuccugggcaccacccagcugucccccgugaacaucugcacguuccggggcgacgucacccacaucgccgggagccgcaacuacaccaugaaccucgccucccugaacuggaacaacuacgacccgaccgaggagauccccgcgccccugggcacgcccgacuucguggggaagauccagggcgugcucacccagaccaccaagggggacggcagcacgcggggccacaaggccaccgucuacaccggguccaccccguucacgcccaagcugggcagcgugcaguucagcaccgacaccgagaacgacuucgagaaccaccagaacaccaaguucacgcccgugggggucauccaggacggcgggaccacccaccgcaacgagccccagcagugggugcugccguccuacagcggccggaacgugcagaacguccaccucgcccccgccguggcccccaccuuccccggcgagcagcugcuguucuuccgcuccacgaugccggggugcagcggcuaccccaacauggaccucgacugccugcugccccaggagugggugcagcacuucuaccaggaggcggcccccgcccaguccgacgucgcccuccugcgguucgugaacccggacaccgggcgcgugcuguucgagugcaagcuccacaagagcggcuacgucaccguggcgcacaccgggcagcacgaccuggugaucccgcccaacggcuacuuccgguucgacuccugggucaaccaguucuacacccuggcccccaugggcaacgggacgggccgccggcgcgcccucuga

SEQ ID NO: 9966 - RNA, 1623 nt, Artificial Sequence
  derived and/or modified sequence opt1 from VP1__Norovirus__BAJ13801
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucgugcucgccgggaacgccuucaccgccggcaagaucaucuucgccgccgugccgcccaacuucccgacggaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugcgggcgaacaacgccggcgaggacguguucaccgucagcugccgcgugcugacccggcccuccccggacuucgacuucaucuuccucgugccgcccaccgucgagagccgcaccaagcccuucacggugcccauccugaccguggaggagaugaccaacucccgguuccccaucccccuggagaagcuguucaccggccccagcggggccuucgucgugcagccgcagaacggccgcugcacgaccgacgggguccugcugggcaccacccagcucucccccgugaacaucugcacguuccggggcgacgugacccacaucgccgggagccgcaacuacaccaugaaccuggccucccugaacuggaacaacuacgaccccaccgaggagaucccggcgccccucggcacgcccgacuucgucgggaagauccagggcgugcugacccagaccaccaagggggacggcagcacgcggggccacaaggccaccguguacaccggguccacccccuucacgccgaagcugggcagcguccaguucagcaccgacaccgagaacgacuucgagaaccaccagaacaccaaguucacgcccgugggggugauccaggacggcgggaccacccaccgcaacgagccccagcaguggguccuccccuccuacagcggccggaacgugcagaacgugcaccuggccccggccgucgcccccaccuuccccggcgagcagcuccucuucuuccgcuccacgaugcccgggugcagcggcuacccgaacauggaccuggacugccugcucccccaggagugggugcagcacuucuaccaggaggcggcccccgcccaguccgacguggcccugcugcgguucgucaaccccgacaccgggcgcguccucuucgagugcaagcugcacaagagcggcuacgugaccguggcgcacaccgggcagcacgaccuggugaucccgcccaacggcuacuuccgguucgacuccugggugaaccaguucuacacccucgcccccaugggcaacgggacgggccgccggcgcgcccuguga

SEQ ID NO: 9967 - RNA, 1623 nt, Artificial Sequence
  derived and/or modified sequence opt1 from VP1__Norovirus__BAJ13804
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacguccagaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9968 - RNA, 1623 nt, Artificial Sequence; identical to SEQ ID NO: 9441
  derived and/or modified sequence opt1 from VP1__Norovirus__BAJ13807

SEQ ID NO: 9969 - RNA, 1623 nt, Artificial Sequence; identical to SEQ ID NO: 9967
  derived and/or modified sequence opt1 from VP1__Norovirus__BAJ13810

SEQ ID NO: 9970 - RNA, 1623 nt, Artificial Sequence; identical to SEQ ID NO: 9967
  derived and/or modified sequence opt1 from VP1__Norovirus__BAJ13816

SEQ ID NO: 9971 - RNA, 1623 nt, Artificial Sequence
  derived and/or modified sequence opt1 from VP1__Norovirus__BAJ13819
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugauccacaucgccgggagccgcaacuacaccaugaaccuggccgcgcugaacuggaacaacuacgaccccaccgaggagaucccggcgccccucggcacccccgacuucguggggaagauccagggcguccugacgcagaccaccaagggggacggcuccacccggggccacaaggccacgguguacaccgggagcgccgacuucacccccaagcugggcuccgugcaguucagcaccgacacggagaacgacuucgagacccaccagaacaccaaguucaccccggucggggugauccaggacggcagcacgacccaccgcaacgagccccagcagugggugcuccccuccuacagcgggcggaacguccacaacgugcaccuggcccccgccguggccccgaccuuccccggcgagcagcuccucuucuuccgcuccaccaugcccggcugcagcggguaccccaacauggaccuggacugccugcucccgcaggaguggguccagcacuucuaccaggaggccgcccccgcgcaguccgacguggcccugcugcgguucgugaaccccgacacgggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcaccgggcgccggcgcgcccuguga

SEQ ID NO: 9972 - RNA, 1623 nt, Artificial Sequence; identical to SEQ ID NO: 9967
  derived and/or modified sequence opt1 from VP1__Norovirus__BAJ13822

SEQ ID NO: 9973 - RNA, 1623 nt, Artificial Sequence
  derived and/or modified sequence opt1 from VP1__Norovirus__BAJ13825
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucaccccgcccacgguggagagccgcaccaagcccuucaccgugcccauccugaccgucgaggagaugacgaacucccgguuccccaucccccuggagaagcuguucaccggccccagcggggccuucguggugcagccgcagaacggccgcugcaccaccgacgggguccugcugggcacgacccagcucucccccgugaacaucugcaccuuccggggcgacgucacccacaucgccgggagccgcaacuacacgaugaaccuggccucccugaacuggaacaacuacgaccccaccgaggagaucccggcgccccucggcacccccgacuucguggggaagauccagggcgugcugacccagacgaccaagggggacggcagcacccggggccacaaggccaccgucuacacgggguccgcccccuucaccccgaagcugggcagcgugcaguucagcaccgacaccgagaacgacuucgaggcccaccagaacacgaaguucacccccgugggggucauccaggacggcuccaccacccaccgcaacgagccccagcagugggugcuccccagcuacuccgggcggaacgugcagaacguccaccuggccccggcgguggcccccacguuccccggcgagcagcuccucuucuuccgcagcaccaugcccggcugcuccggguacccgaacauggaccuggacugccugcucccccaggagugggugcagcacuucuaccaggaggccgcccccgcgcagagcgaccuggcccugcuccgguucgucaaccccgacaccggccgcgugcuguucgagugcaagcugcacaaguccggguacgugaccgucgcccacaccggccagcacgaccucgugaucccgcccaacggguacuuccgguucgacagcugggugaaccaguucuacacgcuggcccccaugggcaacggcaccgggcgccggcgcgcccuguga

SEQ ID NO: 9974 - RNA, 1623 nt, Artificial Sequence
  derived and/or modified sequence opt1 from VP1__Norovirus__BAJ13828
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcacagccuguacuuccgcuccacgaugccgggcugcagcggguaccccaacauggaccucgacugccugcugccccaggaguggguccagcacuucuaccaggaggccgcccccgcccaguccgacguggcgcuccugcgguucgugaacccggacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacggcacggggcgccggcgcgcccucuga

SEQ ID NO: 9975 - RNA, 1623 nt, Artificial Sequence; identical to SEQ ID NO: 9441
  derived and/or modified sequence opt1 from VP1__Norovirus__BAJ13831

SEQ ID NO: 9976 - RNA, 1623 nt, Artificial Sequence; identical to SEQ ID NO: 9162
  derived and/or modified sequence opt1 from VP1__Norovirus__BAJ13834

SEQ ID NO: 9977 - RNA, 1623 nt, Artificial Sequence; identical to SEQ ID NO: 9441
  derived and/or modified sequence opt1 from VP1__Norovirus__BAJ13837

SEQ ID NO: 9978 - RNA, 1623 nt, Artificial Sequence
  derived and/or modified sequence opt1 from VP1__Norovirus__BAJ13840
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccgcgcugaacuggaacaacuacgaccccaccgaggagaucccggcgccccucggcacgcccgacuucguggggaagauccagggcguccugacccagaccaccaaggccgacgggagcacgcggggccacaaggccaccguguacaccggcuccgccguguucacccccaagcuggggagcguccaguucagcacggacaccgagaacgacuucgagacccaccagaacaccaaguucacgccggugggcgugauccaggacggguccaccacccaccgcaacgagccccagcaguggguccuccccagcuacuccggccggaacgugcacaacgugcaccuggcccccgccgucgccccgaccuuccccggggagcagcuccucuucuuccgcagcacgaugcccggcugcuccggcuaccccaacauggaccuggacugccugcucccgcaggagugggugcagcacuucuaccaggaggccgcgcccgcccagagcgacguggcccugcugcgguucgucaaccccgacaccgggcgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgccggcgcgcgcuguga

SEQ ID NO: 9979 - RNA, 1623 nt, Artificial Sequence; identical to SEQ ID NO: 9441
  derived and/or modified sequence opt1 from VP1__Norovirus__BAJ13843

SEQ ID NO: 9980 - RNA, 1623 nt, Artificial Sequence; identical to SEQ ID NO: 9441
  derived and/or modified sequence opt1 from VP1__Norovirus__BAJ13846

SEQ ID NO: 9981 - RNA, 1623 nt, Artificial Sequence; identical to SEQ ID NO: 9441
  derived and/or modified sequence opt1 from VP1__Norovirus__BAJ13849

SEQ ID NO: 9982 - RNA, 1623 nt, Artificial Sequence
  derived and/or modified sequence opt1 from VP1__Norovirus__BAJ13852
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaagcccggguacgugaccguggcccacaccggccagcacgaccuggucauccccuccaacggguacuuccgguucgacagcugggugaaccaguucuacacccucgcccccaugggcaacggcacggggcgccggcgcgcccuguga

SEQ ID NO: 9983 - RNA, 1623 nt, Artificial Sequence
  derived and/or modified sequence opt1 from VP1__Norovirus__BAJ13855
augaagauggccagcaacgacgccaaccccuccgacggcagcgcggccaaccuggugcccgaggucaacaacgaggugauggcccucgaccccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucugccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9984 - RNA, 1623 nt, Artificial Sequence; identical to SEQ ID NO: 9305
  derived and/or modified sequence opt1 from VP1__Norovirus__BAJ13858

SEQ ID NO: 9985 - RNA, 1623 nt, Artificial Sequence
  derived and/or modified sequence opt1 from VP1__Norovirus__BAJ13861
augaagaugcgcagcuccgacgccaaccccagcgacggcuccaccgccaaccuggugccggaggucaacaacgaggugauggcgcucgagcccguggucggggccgccaucgccgcccccguggcgggccagcagaacgugaucgaccccuggauccggaacaacuucguccaggcccccgggggcgaguucaccgugagcccccgcaacgcccccggggagauccugugguccgcgccccugggcccggaccucaaccccuaccugagccaccuggcccggauguacaacggcuacgccgggggcuucgaggugcaggucauccucgccgggaacgccuucacggccggcaagaucaucuucgcggccgugccgcccaacuucccgaccgaggggcugucccccagccaggugaccauguucccccacaucaucgucgacgugcgccagcuggagcccgugcucaucccgcugcccgacguccggaacaacuucuaccacuacaaccaguccaacgaccccaccaucaagcugaucgccaugcucuacacgccccugcgcgccaacaacgccggcgacgacguguucaccggcagcugccgggugcugacccgcccgucccccgacuucgacuucaucuuccucgucccgcccaccguggagagccggacgaagcccuucuccgugagcuucuucaccggggaggagaugaccaacucccgcuuccccaucccccuggagaagcuguucaccggccccagcuccgcguucgucgugcagccgcagaacgggcggugcacgaccgacggcgugcuccugggcaccacccagcugagccccgucaacaucugcacguuccgcggggacgugacccacaucaccggcucccggaacuacaccaugaaccucgccacgcagaacuggaacagcuacgaccccaccgaggagaucccggcgccccuggggacccccgacuucgucggcaagauccagggggugcugacccagacgacccgcgccgacggcagcacccggggccacaaggccaccguguacacgggguccgccgacuucgcccccaagcucggccgcguccaguucgccaccgacaccgacaacgacuucgacgccaaccagaacaccaaguucacgccggugggggugauccaggacggcgacaccgcccaccggaacgagccccagcaguggguccugcccagcuacuccgggcgcaacagccacaacgugcaccuggcgcccgccguggccccgaccuuccccggcgagcagcuccuguucuuccgguccaccaugcccggcugcagcggguaccccaacauggaccuggacugccuccugccgcaggaguggguccaguacuucuaccaggaggccgcgcccgcccaguccgacguggcccugcuccgcuucgugaaccccgacacgggccggguccuguucgagugcaagcugcacaagagcggguacgugaccguggcccacaccggccagcacgaccucgucaucccgcccaacggguacuuccgcuucgacuccugggugaaccaguucuacacccuggcccccaugggcaacggcaccgggcgccggcgcgcgcuguga

SEQ ID NO: 9986 - RNA, 1623 nt, Artificial Sequence; identical to SEQ ID NO: 9305
  derived and/or modified sequence opt1 from VP1__Norovirus__BAJ13864

SEQ ID NO: 9987 - RNA, 1623 nt, Artificial Sequence
  derived and/or modified sequence opt1 from VP1__Norovirus__BAJ13867
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacugcauccucgaccugccgcccaccguggagagccgcacgaagcccuucuccgugcccauccugaccgucgaggagaugaccaacagccgguuccccaucccccucgagaagcuguucaccggcccguccagcgccuucguggugcagccccagaacgggcgcugcacgaccgacggcguccugcucgggaccacccagcugucccccgugaacaucugcacguuccggggcgacgucacccacaucaccggcagccgcaacuacaccaugaaccuggccacgcagaacuggaacuccuacgacccgaccgaggagauccccgcgccccucgggacccccgacuucgugggcaagauccagggggugcugacccagacgacccgggccgacggcagcacccgcgggcacaaggccaccgucuacacgggcagcgccgacuucgccccgaagcugggccgggugcaguucgccaccgacaccgacaacgacuucgacgccaaccagaacaccaaguucacgcccgugggggucauccaggacggcgacaccgcgcaccgcaacgagccccagcagugggugcuccccuccuacagcgggcggaacucccacaacgugcaccuggccccggccgucgcccccaccuuccccggcgagcagcuccucuucuuccgcagcaccaugcccgggugcuccggcuacccgaacauggaccuggacugccugcucccccaggagugggugcaguacuucuaccaggaggcggcccccgcccagagcgacguggcccugcugcgguucgucaaccccgacacgggccgcgugcuguucgagugcaagcugcacaaguccggguacgugaccgucgcccacaccggccagcacgaccuggugaucccgcccaacggguacuuccgguucgacagcugggugaaccaguucuacacccucgcgcccaugggcaacgggaccggccgccgccgggcccuguga

SEQ ID NO: 9988 - RNA, 1623 nt, Artificial Sequence
  derived and/or modified sequence opt1 from VP1__Norovirus__BAJ13873
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggugguguucaccgucuccugccgcgugcugacccggcccagcccggacuucgacuucaucugccucgugccgcccaccgucgagucccgcaccaagcccuucacggugcccauccugaccguggaggagaugaccaacagccgguuccccaucccccuggagaagcuguucaccggccccuccagcgccuucgucgugcagccgcagaacgggcgcugcacgaccgacggcguccugcuggggaccacccagcucucccccgugaacaucugcacguuccggggcgacgugacccacaucgccggcagccgcaacuacaccaugaaccuggccucccugaacuggaacaacuacgaccccaccgaggagaucccggcgccccucgggacgcccgacuucgucggcaagauccagggggugcugacccagaccaccaagggcgacgggagcacgcggggccacaaggccaccguguacaccggcagcgcccccuucaccccgaagcugggguccguccaguucagcacggacaccgagaacgacuucgagacccaccagaacaccaaguucacgcccgugggcgugauccaggacgggggcaccacccaccgcaacgagccccagcaguggguccuccccuccuacagcgggcggaacgugccgaacgugcaccuggcccccgccgucgcgcccaccuuccccggcgagcagcuccucuucuuccgcuccacgaugccgggcugcagcggguaccccaacauggaccuggacugccugcucccccaggagugggugcagcacuucuaccaggaggccgcccccgcccaguccgacguggcgcugcugcgguucgucaacccggacaccggccgcguccucuucgagugcaagcugcacaagcccggguacgugaccguggcccacaccggccagcacgaccuggugauccccagcaacggguacuuccgguucgacuccugggugaaccaguucuacacccucgcccccaugggcaacggcacggggcgccggcgcgcccuguga

SEQ ID NO: 9989 - RNA, 1623 nt, Artificial Sequence
  derived and/or modified sequence opt1 from VP1__Norovirus__BAJ13876
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccgcgcugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgccgacuucacccccaagcugggcuccgugcaguucagcacggacaccgagaacgacuucgagacccaccagaacaccaaguucacgccggucggggugauccaggacggcagcaccacccaccgcaacgagccccagcagugggugcuccccuccuacagcgggcggaacguccacaacgugcaccuggcccccgccguggccccgaccuuccccggcgagcagcuccucuucuuccgcuccacgaugcccggcugcagcggguaccccaacauggaccuggacugccugcucccgcaggaguggguccagcacuucuaccaggaggccgcccccgcgcaguccgacguggcccugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 9990 - RNA, 1623 nt, Artificial Sequence
  derived and/or modified sequence opt1 from VP1__Norovirus__BAJ13879
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccauggaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 9991 - RNA, 1623 nt, Artificial Sequence; identical to SEQ ID NO: 9162
  derived and/or modified sequence opt1 from VP1__Norovirus__BAJ13882

SEQ ID NO: 9992 - RNA, 1623 nt, Artificial Sequence
  derived and/or modified sequence opt1 from VP1__Norovirus__BAJ13885
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcaacaccgcgcaccgcaacgagccccagcagugggugcugcccuccuacagcgggcggaacucccacaacguccaccucgccccggccguggcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacgucgcccuccugcgguucgugaaccccgacacgggccgcgugcuguucgagugcaagcuccacaaguccggguacgucaccguggcccacaccggccagcacgaccuggugaucccgcccaacggguacuuccgguucgacagcugggucaaccaguucuacacccuggcgcccaugggcaacgggaccggccgccgccgggcccucuga

SEQ ID NO: 9993 - RNA, 1623 nt, Artificial Sequence
  derived and/or modified sequence opt1 from VP1__Norovirus__BAJ13891
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggccagccgcacgaagcccuucuccguccccagcgugaccguggaggagaugaccaacucccgguuccccaucccccuggagaagcuguucaccggcccgagcuccgccuucgucgugcagccccagaacgggcgcugcacgaccgacggcguccuccuggggaccacccagcugagccccgugaacaucugcacguuccggggcgacgugacccacaucaccggcucccgcaacuacaccaugaaccucgccacgcagaacuggaacagcuacgacccgaccgaggagauccccgcgccccuggggacccccgacuucgucggcaagauccagggggugcugacccagacgacccgggccgacggcagcacccgcgggcacaaggccaccguguacacgggcuccgccgacuucgccccgaagcucggccggguccaguucgccaccgacaccgacaacgacuucgacgcgaaccagaacaccaaguucacgcccgugggggugauccaggacggcgacaccgcccaccgcaacgagccccagcaguggguccugcccagcuacuccgggcggaacagccacaacgugcaccuggccccgaccguggcccccaccuuccccggcgagcagcuccuguucuuccgcuccacgaugcccgggugcagcggcuacccgaacauggaccuggacugccuccugccccaggaguggguccaguacuucuaccaggaggcggcccccgcccaguccgacguggcccugcuccgguucgugaaccccgacaccggccgcguccuguucgagugcaagcugcacaagagcggguacgugaccguggcccacaccggccagcacgaccucgucaucccgcccaacggguacuuccgguucgacuccugggugaaccaguucuacacccuggcgcccaugggcaacgggacgggccgccgccgggcccuguga

SEQ ID NO: 9994 - RNA, 1623 nt, Artificial Sequence
  derived and/or modified sequence opt1 from VP1__Norovirus__BAJ13894
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccagaacgcccccuccgagauccugugguccgcgccccuggggccggaccucaaccccuaccugagccaccuggcccggauguacaacggcuacgccggcggguucgaggugcaggucauccucgccggcaacgccuucacggcggggaagaucaucuucgccgccgugccgcccaacuucccgaccgagggccugucccccagccaggugaccauguucccccacaucaucgucgacgugcgccagcuggagcccgugcucaucccgcugcccgacguccggaacaacuucuaccacuacaaccaguccaacgaccccaccaucaagcugaucgccaugcucuacacgccccugcgcgccaacaacgcgggggacgacguguucaccgugagcugccggguccugacccgcccgucccccgacuucgacuucaucuuccucgugccgcccaccguggagagccggacgaagcccuucaccguccccauccugaccguggaggagaugaccaacucccgcuuccccaucccccuggagcggcucuacacgggcccgagcuccgccuucgugguccagccccagaacggccgcugcaccaccgacggggugcugcugggcaccacgcagcucagcgccgucaacaucugcaccuuccgcggggacgugacccacaucgccggcucccggaacuacaccaugaaccuggccagccagaacuggaacaacuacgaccccacggaggagaucccggcgccccugggcacccccgacuucguggggaagauccagggcaugcucacccagaccacgcgguccgacgggagcacccgcggccacaaggccaccguccugaccgggagcgccgacuucgcccccaagcugggccgggugcaguucgccacggacaccgacaacgacuucgaguccggccagaacaccaaguucaccccggugggggucauccaggacggcagcacgacccaccgcaacgagccccagcagugggugcuccccaacuacuccgggcggaccggccacaacgugcaccuggcgcccgccgucgccccgaccuaccccggggagcagcuccucuucuuccgcagcacgaugcccggcugcuccggcuaccccaacauggaccuggacugccugcucccgcaggagugggugcagcacuucuaccaggaggccgcgcccgcccagagcgacguggcccugcugcgguucgucaaccccgacaccgggcgcgugcuguucgagugcaagcugcacaaguccggcuacgugaccgucgcccacaccgggcagcacgaccuggugaucccgcccaacggcuacuuccgguucgacagcugggugaaccaguucuacacccucgcccccauggggaacggcacgggccgccgccgggcggucuga

SEQ ID NO: 9995 - RNA, 1623 nt, Artificial Sequence
  derived and/or modified sequence opt1 from VP1__Norovirus__BAJ13897
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaccguguacacgggcagcgccgacuucgccccgaagcugggccgggugcaguucgccaccgacaccgacaacgacuucgacgccaaccagaacaccaaguucacgcccgucggggugauccaggacggcgacaccgcgcaccgcaacgagccccagcagugggugcugcccuccuacagcgggcggaacucccacaacguccaccucgccccgaccguggcccccaccuuccccggcgagcagcugcuguucuuccgcagcacgaugcccgggugcuccggcuacccgaacauggaccucgacugccugcugccccaggagugggugcaguacuucuaccaggaggccgcgcccgcccagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgggcgcucuga

SEQ ID NO: 9996 - RNA, 1623 nt, Artificial Sequence
  derived and/or modified sequence opt1 from VP1__Norovirus__BAJ13900
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagcgccucuacacgggcccguccagcgccuucgugguccagccccagaacgggcggugcaccaccgacggcgugcugcuggggaccacgcagcucuccgccgucaacaucugcaccuuccgcggcgacgugacccacaucgccggcagccggaacuacaccaugaaccuggccucccagaacuggaacaacuacgaccccacggaggagaucccggcgccccuggggacccccgacuucgugggcaagauccaggggaugcucacccagaccacgcgcagcgacggcuccacccgggggcacaaggccaccguccugaccggcagcgccgacuucgcccccaagcugggccgcgugcaguucgccacggacaccgacaacgacuucgagagcgggcagaacaccaaguucaccccggugggcgucauccaggacggguccacgacccaccggaacgagccccagcagugggugcuccccaacuacagcggccgcaccgggcacaacgugcaccuggcgcccgccgucgccccgaccuaccccggcgagcagcuccucuucuuccgguccacgaugcccggcugcagcggguaccccaacauggaccuggacugccugcucccgcaggagugggugcagcacuucuaccaggaggccgcgcccgcccaguccgacguggcccugcugcgcuucgucaaccccgacaccggccgggugcuguucgagugcaagcugcacaagagcggguacgugaccgucgcccacaccggccagcacgaccuggugaucccgcccaacggguacuuccgcuucgacuccugggugaaccaguucuacacccucgcccccaugggcaacggcacggggcgccggcgcgcggucuga

SEQ ID NO: 9997 - RNA, 1623 nt, Artificial Sequence; identical to SEQ ID NO: 9989
  derived and/or modified sequence opt1 from VP1__Norovirus__BAJ13903

SEQ ID NO: 9998 - RNA, 1623 nt, Artificial Sequence; identical to SEQ ID NO: 9996
  derived and/or modified sequence opt1 from VP1__Norovirus__BAJ13906

SEQ ID NO: 9999 - RNA, 1623 nt, Artificial Sequence
  derived and/or modified sequence opt1 from VP1__Norovirus__BAJ13909
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucaccggcucccgcaacuacaccaugaaccuggccagccugaacuggaacaacuacgaccccacggaggagaucccggcgccccucgggacccccgacuucgugggcaagauccaggggguccugacccagaccacgaagggcgacggguccacccggggccacaaggccaccguguacaccggcagcgccgacuucacgcccaagcuggggagcgugcaguucgccaccgacaccgagaacgacuucgagacccaccagaacacgaaguucaccccggucggcgugauccaggacgggggcaccacccaccgcaacgagccccagcagugggugcuccccuccuacagcgggcggaacguccacaacgugcaccuggcccccgccguggcgccgaacuuccccggcgagcagcuccucuucuuccgcuccacgaugcccggcugcagcggguaccccaacauggaccuggacugccugcucccgcaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 10000 - RNA, 1623 nt, Artificial Sequence; identical to SEQ ID NO: 9162
  derived and/or modified sequence opt1 from VP1__Norovirus__BAJ13912

SEQ ID NO: 10001 - RNA, 1623 nt, Artificial Sequence; identical to SEQ ID NO: 9927
  derived and/or modified sequence opt1 from VP1__Norovirus__BAJ13918

SEQ ID NO: 10002 - RNA, 1623 nt, Artificial Sequence
  derived and/or modified sequence opt1 from VP1__Norovirus__BAJ13924
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacguccagaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 10003 - RNA, 1623 nt, Artificial Sequence
  derived and/or modified sequence opt1 from VP1__Norovirus__BAJ13927
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccgggggcgcccccuucacgccgaagcugggguccgcccaguucagcaccgacaccgagaacgacuucgagacccaccagaacacgaaguucacccccgugggcgucauccaggacgggggcaccacccaccgcaacgagccccagcagugggugcuccccagcuacuccggccggaacgugcacaacguccaccuggccccggcgguggcccccacguuccccggggagcagcuccucuucuuccgcagcaccaugcccggcugcuccggguacccgaacauggaccuggacugccugcucccccaggagugggugcagcacuucuaccaggaggccgcccccgcgcagagcgacgucgcccugcugcgguucgugaaccccgacaccggccgcguccucuucgagugcaagcugcacaaguccggguacgugaccguggcccacaccggccagcacgaccuggugaucccgcccaacggcuacuuccgguucgacagcugggucaaccaguucuacacgcucgcccccauggggaacggcaccgggcgccggcgcgcccuguga

SEQ ID NO: 10004 - RNA, 1623 nt, Artificial Sequence
  derived and/or modified sequence opt1 from VP1__Norovirus__BAJ13930
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccuggacccggaccucaaccccuaccugucccagcuggcccgcauguacaacggcuacgccggcggguucgaggugcaggucauccucgccggcaacgccuucaccgccgggaagaucaucuucgccgccgugccgcccaacuucccgacggagggccugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggggaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacggccgcugcacgaccgacggggugcugcugggcaccacccagcucagccccgucaacaucugcacguuccgcggggacgugacccacaucgccggcucccggaacuacaccaugaaccuggccagccugaacuggaacaacuacgaccccaccgaggagaucccggcgccccucggcacgcccgacuucguggggaagauccagggcguccugacccagaccaccaagggggacggcuccacgcgggggcacaaggccaccguguacaccggcagcgcccccuucaccccgaagcugggcagcgugcaguucuccacggacaccgagaacgacuucgagacccaccagaacaccaaguucacgcccgucggggugauccaggacggcgggaccacccaccgcaacgagccccagcagugggugcuccccagcuacuccggccggaacgucccgaacgugcaccuggcccccgccguggcgcccaccuuccccggggagcagcuccucuucuuccgcagcacgaugccgggcugcuccggcuaccccaacauggaccuggacugccugcucccccaggaguggguccagcacuucuaccaggaggccgcccccgcccagagcgacguggcgcugcugcgguucgugaacccggacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcccuguga

SEQ ID NO: 10005 - RNA, 1623 nt, Artificial Sequence; identical to SEQ ID NO: 9305
  derived and/or modified sequence opt1 from VP1__Norovirus__BAJ13933

SEQ ID NO: 10006 - RNA, 1623 nt, Artificial Sequence; identical to SEQ ID NO: 9162
  derived and/or modified sequence opt1 from VP1__Norovirus__BAJ13936

SEQ ID NO: 10007 - RNA, 1623 nt, Artificial Sequence; identical to SEQ ID NO: 9441
  derived and/or modified sequence opt1 from VP1__Norovirus__BAJ13939

SEQ ID NO: 10008 - RNA, 1623 nt, Artificial Sequence
  derived and/or modified sequence opt1 from VP1__Norovirus__BAJ13942
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcgacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgagacccaccagaacacgaaguucacccccgucggggugauccaggacggcgggaccacccaccgcaacgagccccagcagugggugcuccccuccuacagcggccggaacguccacaacgugcaccuggccccggccguggcgcccacguuccccggcgagcagcuccucuucuuccgcuccaccaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacgcucgcccccaugggcaacgggaccggccgccggcgcgcccuguga

SEQ ID NO: 10009 - RNA, 1623 nt, Artificial Sequence; identical to SEQ ID NO: 9967
  derived and/or modified sequence opt1 from VP1__Norovirus__BAJ13945

SEQ ID NO: 10010 - RNA, 1623 nt, Artificial Sequence
  derived and/or modified sequence opt1 from VP1__Norovirus__BAJ13948
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggaacaccacccaccgcaacgagccccagcagugggugcuccccagcuacuccggccggaacguccagaacgugcaccuggccccggccguggcgcccaccuuccccggggagcagcuccucuucuuccgcagcacgaugcccggcugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcccuguga

SEQ ID NO: 10011 - RNA, 1623 nt, Artificial Sequence; identical to SEQ ID NO: 9305
  derived and/or modified sequence opt1 from VP1__Norovirus__BAJ13951

SEQ ID NO: 10012 - RNA, 1623 nt, Artificial Sequence
  derived and/or modified sequence opt1 from VP1__Norovirus__BAJ13954
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggaacaccacccaccgcaacgagccccagcagugggugcuccccagcuacuccggccggaacgugcagaacguccaccuggccccggccguggcgcccaccuuccccggggagcagcuccucuucuuccgcagcacgaugcccggcugcuccggcuacccgaacauggaccuggacugccugcucccccaggagugggugcagcacuucuaccaggaggccgcccccgcccagagcgacgucgcgcugcugcgguucgugaaccccgacaccgggcgcguccucuucgagugcaagcugcacaaguccggcuacgugaccguggcccacaccgggcagcacgaccuggugaucccgcccaacggcuacuuccgguucgacagcugggucaaccaguucuacacccucgcccccauggggaacggcacgggccgccggcgcgcccuguga

SEQ ID NO: 10013 - RNA, 1623 nt, Artificial Sequence
  derived and/or modified sequence opt1 from VP1__Norovirus__BAJ13957
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcccccuccggcccggaccugaaccccuaccucagccaccuggcccgcauguucaacgacuacgccggcggguucgaggugcaggucauccuggccggcaacgcguucacggccgggaagaucaucuucgccgccgugccgcccaacuucccgaccgagggccucucccccagccaggugaccauguucccccacaucaucgucgacgugcggcagcuggagcccgugcugaucccgcuccccgacguccgcaacaacuucuaccacuacaaccaguccaacgacagcaccaucaagcugaucgccaugcuguacacgccccuccgggcgaacaacgccggggaggacguguucaccguguccugccgcguccugacccggcccagcccggacuucgacuucaucuuccuggugccgcccaccguggagucccgcacgaagcccuucaccguccccauccucaccguggaggagaugaccaacagccgguuccccaucccccuggagaagcuguucacgggccccuccggcgccuucgugguccagccgcagaacgggcgcugcaccaccgacggcgugcuccuggggaccacgcagcugagccccgucaacaucugcaccuuccggggcgacgugacccacaucgccggcucccgcaacuacaccaugaaccucgccagccugaacuggaacaacuacgaccccacggaggagaucccggcgccccuggggacccccgacuucgugggcaagauccaggggguccucacccagaccacgaagggcgacggguccacccggggccacaaggccaccguguacaccggcagcgcccccuucacgccgaagcuggggagcgugcaguucuccaccgacaccgagaacgacuucgaggcccaccagaacaccaaguucacgcccgucggcgugauccaggacgggagcaccacccaccgcaacgagccccagcagugggugcugcccuccuacagcggccggaacguccagaacgugcaccucgccccggcgguggcccccaccuuccccggggagcagcugcuguucuuccgcuccacgaugcccggcugcagcggcuacccgaacauggaccucgacugccugcugccccaggaguggguccagcacuucuaccaggaggccgcccccgcgcaguccgacguggcccuccugcgguucgugaaccccgacaccgggcgcguccuguucgagugcaagcuccacaagagcggcuacgugaccguggcccacaccgggcagcacgaccuggucaucccgcccaacggcuacuuccgguucgacuccugggugaaccaguucuacacccuggcccccauggggaacggcacgggccgccggcgcgcccucuga

SEQ ID NO: 10014 - RNA, 1623 nt, Artificial Sequence; identical to SEQ ID NO: 9441
  derived and/or modified sequence opt1 from VP1__Norovirus__BAJ13960

SEQ ID NO: 10015 - RNA, 1623 nt, Artificial Sequence; identical to SEQ ID NO: 9441
  derived and/or modified sequence opt1 from VP1__Norovirus__BAJ13963

SEQ ID NO: 10016 - RNA, 1623 nt, Artificial Sequence; identical to SEQ ID NO: 9927
  derived and/or modified sequence opt1 from VP1__Norovirus__BAJ13966

SEQ ID NO: 10017 - RNA, 1623 nt, Artificial Sequence; identical to SEQ ID NO: 9162
  derived and/or modified sequence opt1 from VP1__Norovirus__BAJ13969

SEQ ID NO: 10018 - RNA, 1623 nt, Artificial Sequence
  derived and/or modified sequence opt1 from VP1__Norovirus__BAJ13972
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcgacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgugcccuucaccccgaagcugggcagcguccaguucagcacggacaccgagaacgacuucgagacccaccagaacaccaaguucacgcccgugggggugauccaggacggcuccaccacccaccgcaacgagccccagcaguggguccuccccagcuacuccgggcggaacgugcacaacgugcaccuggccccggccgucgcccccaccuuccccggcgagcagcuccucuucuuccgcagcacgaugcccggcugcuccggguacccgaacauggaccuggacugccugcucccccaggagugggugcagcacuucuaccaggaggcggcccccgcccagagcgacguggcccugcugcgguucgucaaccccgacaccggccgcguccucuucgagugcaagcugcacaaguccggguacgugaccguggcgcacaccggccagcacgaccuggugaucccgcccaacggguacuuccgguucgacagcugggugaaccaguucuacacccucgcccccaugggcaacggcacggggcgccggcgcgcccuguga

SEQ ID NO: 10019 - RNA, 1623 nt, Artificial Sequence
  derived and/or modified sequence opt1 from VP1__Norovirus__BAJ13975
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgccgacuucacccccaagcuggggagcgugcaguucgccacggacaccgagaacgacuucgagacccaccagaacaccaaguucacgccggucggcgugauccaggacgggggcaccacccaccgcaacgagccccagcagugggugcuccccuccuacagcgggcggaacguccacaacgugcaccuggcccccgcgguggccccgaacuuccccggcgagcagcuccucuucuuccgcuccaccaugcccggcugcagcggguaccccaacauggaccuggacugccugcucccgcaggaguggguccagcacuucuaccaggaggccgcccccgcgcaguccgacguggcccugcugcgguucgugaaccccgacacgggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcaccgggcgccggcgcgcccuguga

SEQ ID NO: 10020 - RNA, 1623 nt, Artificial Sequence
  derived and/or modified sequence opt1 from VP1__Norovirus__BAJ13978
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccacccccuucacgccgaagcugggcagcgugcaguucagcaccgacaccgagaacgacuucgagacccaccagaacacgaaguucacccccgucggggugauccaggacggcuccaccauccaccgcaacgagccccagcagugggugcuccccagcuacuccgggcggaacguccagaacgugcaccuggccccggccguggcccccaccuuccccggcgagcagcuccucuucuuccgcagcacgaugcccggcugcuccggguacccgaacauggaccuggacugccugcucccccaggaguggguccagcacuucuaccaggaggcggcccccgcccagagcgacguggcccugcugcgguucgugaaccccgacaccggccgcguccucuucgagugcaagcugcacaaguccggguacgugaccguggcgcacaccggccagcacgaccuggucaucccgcccaacggguacuuccgguucgacagcugggugaaccaguucuacacccucgcccccaugggcaacggcacggggcgccggcgcgcccuguga

SEQ ID NO: 10021 - RNA, 1623 nt, Artificial Sequence; identical to SEQ ID NO: 9441
  derived and/or modified sequence opt1 from VP1__Norovirus__BAJ13981

SEQ ID NO: 10022 - RNA, 1623 nt, Artificial Sequence; identical to SEQ ID NO: 9162
  derived and/or modified sequence opt1 from VP1__Norovirus__BAJ13984

SEQ ID NO: 10023 - RNA, 1623 nt, Artificial Sequence; identical to SEQ ID NO: 9162
  derived and/or modified sequence opt1 from VP1__Norovirus__BAJ13987

SEQ ID NO: 10024 - RNA, 1623 nt, Artificial Sequence
  derived and/or modified sequence opt1 from VP1__Norovirus__BAJ13990
augaagauggccagcaacgacgccucccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacgucccgaacgugcaccuggcccccgccguggcgcccaccuuccccggcgagcagcuccucuucuuccgcuccacgaugccgggcugcagcggguaccccaacauggaccuggacugccugcucccccaggaguggguccagcacuucuaccaggaggccgcccccgcccaguccgacguggcgcugcugcgguucgugaacccggacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 10025 - RNA, 1623 nt, Artificial Sequence; identical to SEQ ID NO: 9162
  derived and/or modified sequence opt1 from VP1__Norovirus__BAJ13993

SEQ ID NO: 10026 - RNA, 1623 nt, Artificial Sequence; identical to SEQ ID NO: 9967
  derived and/or modified sequence opt1 from VP1__Norovirus__BAJ13996

SEQ ID NO: 10027 - RNA, 1623 nt, Artificial Sequence; identical to SEQ ID NO: 9904
  derived and/or modified sequence opt1 from VP1__Norovirus__BAJ13999

SEQ ID NO: 10028 - RNA, 1623 nt, Artificial Sequence; identical to SEQ ID NO: 9967
  derived and/or modified sequence opt1 from VP1__Norovirus__BAJ14002

SEQ ID NO: 10029 - RNA, 1623 nt, Artificial Sequence
  derived and/or modified sequence opt1 from VP1__Norovirus__BAJ14005
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccugauccugaccguggaggagaugaccaacucccgguuccccaucccccucgagaagcuguucaccggccccagcuccgccuucgugguccagccccagaacgggcgcugcacgaccgacggcgugcugcucgggaccacccagcugagcccggucaacaucugcacguuccggggcgacgugacccacaucgccggcucccgcaacuacaccaugaaccuggccagccucaacuggaacaacuacgaccccaccgaggagauccccgcgccgcuggggacgcccgacuucgugggcaagauccaggggguccugacccagaccaccaagggcgacggguccacgcggggccacaaggccaccguguacaccggcagcgcccccuucacccccaagcucgggagcgugcaguucuccacggacaccgagaacgacuucgagauccaccagaacaccaaguucaccccggucggcgugauccaggacgggagcacgacccaccgcaacgagccccagcagugggugcugcccuccuacagcggccggaacguccacaacgugcaccuggcccccgccguggcgccgaccuuccccggggagcagcuccuguucuuccgcuccaccaugcccggcugcagcggcuaccccaacauggaccuggacugccuccugccgcaggaguggguccagcacuucuaccaggaggccgcccccgcccaguccgacguggcgcugcuccgguucgugaaccccgacacggggcgcguccuguucgagugcaagcugcacaagagcggcuacgugaccguggccuacaccgggcagcacgaccucgucaucccgcccaacggcuacuuccgguucgacuccugggugaaccaguucuacacccuggcccccauggggaacggcaccggccgccggcgcgcccuguga

SEQ ID NO: 10030 - RNA, 1623 nt, Artificial Sequence
  derived and/or modified sequence opt1 from VP1__Norovirus__BAJ14008
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccgugcugaccguggaggagaugaccaacucccgguuccccaucccccuggagaagcuguucacgggccccagcggggccuucgucgugcagccgcagaacggccgcugcaccaccgacgggguccugcugggcaccacgcagcucucccccgugaacaucugcaccuuccggggcgacgugacccacaucgccgggagccgcaacuacaccaugaaccuggccucccugaacuggaacaacuacgaccccacggaggagaucccggcgccccucggcacccccgacuucgucgggaagauccagggcgugcugacccagaccacgaagggggacggcagcacccggggccacaaggccaccguguacaccggguccgcccccuucacgccgaagcugggcagcguccaguucagcaccgacaccgagaacgacuucgagacccaccagaacacgaaguucacccccgugggggugauccaggacggcuccaccacccaccgcaacgagccccagcaguggguccuccccagcuacuccgggcggaacgugcacaacgugcaccuggccccggccgucgcgcccacguuccccggcgagcagcuccucuucuuccgcagcaccaugcccggcugcuccggguacccgaacauggaccuggacugccugcucccccaggagugggugcagcacuucuaccaggaggccgcccccgcccagagcgagguggcgcugcugcgguucgucaaccccgacaccggccgcguccucuucgagugcaagcugcacaaguccggguacgugaccguggcccacaccggccagcacgaccuggugaucccgcccaacggguacuuccgguucgacagcugggugaaccaguucuacacgcucgcccccaugggcaacggcaccgggcgccggcgcgcccuguga

SEQ ID NO: 10031 - RNA, 1623 nt, Artificial Sequence
  derived and/or modified sequence opt1 from VP1__Norovirus__BAJ14011
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagauccaccagaacaccaaguucacccccgucggcgugauccaggacgggagcacgacccaccgcaacgagccccagcagugggugcuccccuccuacagcggccggaacguccacaacgugcaccuggccccggccguggcgcccaccuuccccggggagcagcuccucuucuuccgcuccaccaugcccggcugcagcggcuacccgaacauggaccuggacugccugcucccccaggaguggguccagcacuucuaccaggaggccgcccccgcccaguccgacguggcgcugcugcgguucgugaaccccgacacggggcgcguccucuucgagugcaagcugcacaagagcggcuacgugaccguggccuacaccgggcagcacgaccuggucaucccgcccaacggcuacuuccgguucgacuccugggugaaccaguucuacacccucgcccccauggggaacggcaccggccgccggcgcgcccuguga

SEQ ID NO: 10032 - RNA, 1623 nt, Artificial Sequence; identical to SEQ ID NO: 9162
  derived and/or modified sequence opt1 from VP1__Norovirus__BAJ14014

SEQ ID NO: 10033 - RNA, 1623 nt, Artificial Sequence
  derived and/or modified sequence opt1 from VP1__Norovirus__BAK43269
auggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgccucuacaacggcuacgccgggggcauggagguccaggugaugcuggcggggaacgccuucaccgccggcaagcugguguuccccgccgucccgccccacuuccccaucgagaaccucagcccccagcagaucaccauguucccccacgugaucaucgacgugcggacgcuggagcccguccugcucccgcugcccgacgugcgcaacaacuucuuccacuacaaccagaaggacgaccccaagaugcggaucguggcgaugcuguacacgccccuccgcuccaacgggagcggcgacgacgucuucaccguguccugccgggugcugacccgcccgagccccgacuucgacuucaccuaccuggucccgcccaccguggaguccaagaccaagcccuucacccuccccauccugacgcugggcgagcucagcaacucccgguuccccgugagcaucgaccagauguacaccucccccaacgaggucaucagcgugcagugccagaacgggcgcugcacccuggacggcgagcugcaggggaccacgcagcuccagguguccggcaucugcgccuucaagggcgaggucaccgcccaccuccacgacaacgaccaccuguacaacaucaccaucaccaaccucaacgggagcccguucgaccccuccgaggacauccccgccccgcugggcgugcccgacuuccaggggcgggucuucggcaucaucagccagcgcgacaagcacaacucccccgggcacaacgagcccgccaaccggggccacgacgcgguggugccgacguacaccgcccaguacacccccaagcugggccagauccagaucgggaccuggcagacggacgaccucaccgucagccagcccgugaaguucacccccgugggccugaacgacaucgagcacuucaaccagugggucgugccgcgcuacgccggggcccugaaccucaacaccaaccuggcccccagcguggcgcccgucuuccccggcgagcggcugcuguucuuccgcuccuacaucccgcugaagggcggguacggcaaccccgccaucgacugccugcucccccaggagugggugcagcacuucuaccaggaggccgcccccagcauguccgagguggcgcugguccgguacaucaacccggacacggggcgcgcccuguucgaggccaagcuccaccgggccggcuucaugaccgugagcuccaacaccagcgcccccguggucgugcccgcgaacggguacuuccgcuucgacuccugggugaaccaguucuacagccuggcccccaugggcaccgggaacggccggcgccgcguccaguga

SEQ ID NO: 10034 - RNA, 1623 nt, Artificial Sequence
  derived and/or modified sequence opt1 from VP1__Norovirus__BAK43272
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacacccagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaagucccgguacgugaccguggcccacaccgggcagcacgaccuggucaucccgcccaacggcuacuuccgcuucgacagcugggugaaccaguucuacacccucgcccccauggggaacggcacgggccggcgccgcgcccuguga

SEQ ID NO: 10035 - RNA, 1647 nt, Artificial Sequence
  derived and/or modified sequence opt1 from VP1__Norovirus__BAK43275
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcuggucgccaugcuguacaccccgcuccgcgccaacaacuccggcgacgacguguucaccgugagcugccggguccugacgcgccccucccccgacuucagcuucaacuuccuggugcccccgaccguggaguccaagaccaagcccuucacccuccccauccugacgaucagcgagauguccaacagccgguuccccgucccgaucgacucccugcacaccagccccaccgagaacaucguggugcagugccagaacgggcgcgucacccucgacggcgagcugauggggacgacccagcugcuccccucccagaucugcgccuuccggggcgugcugacccgcagcaccucccgggcgagcgaccaggccgacacggccacgccccgccuguucaacuacuacuggcacauccagcucgccaaccugaacggcaccccguacgaccccgccgaggacauccccgggccgcugggcacccccgacuuccgggggaagguguucggcgucgcgugccagcgcaaccccgacugcaccacccgggcccacgaggccaagguggacaccaccgccgggcgcuucacgcccaagcucggcagccuggagaucuccaccgagagcggcgacuucgaccagaaccagccgacccgguucacccccgucgggaucggcguggaccacgaggcggacuuccagcaguggucccugcccgacuacagcgggcaguucacgcacaacaugaaccucgcccccgccguggccccgaacuuccccggcgagcagcugcuguucuuccgcucccagcuccccagcuccgggggccggagcaacggcauccuggacugccuggucccccaggagugggugcagcacuucuaccaggaguccgccccggcgcagacccagguggcccucguccgcuacgugaaccccgacaccgggcgcgugcuguucgaggccaagcugcacaagcucggcuucaugaccaucgccaagaacggggacagccccaucacggugcccccgaacggcuacuuccgguucgaguccugggugaaccccuucuacacccuggcccccauggggaccggcaacggccgccggcgcauccaguga

SEQ ID NO: 10036 - RNA, 1623 nt, Artificial Sequence
  derived and/or modified sequence opt1 from VP1__Norovirus__BAK43278
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacacccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcuccuacgugaccguggcgcacaccgggcagcacgaccuggucaucccgcccaacggcuacuuccgguucgacagcugggugaaccaguucuacacgcuggcccccauggggaacggcaccgggcgccgccacgcccucuga

SEQ ID NO: 10037 - RNA, 1623 nt, Artificial Sequence
  derived and/or modified sequence opt1 from VP1__Norovirus__BAK43284
auggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucucccuggagcugggccccgagcucaacccguaccuggcccaccuggcccgcauguacaacggcuacgccgggggcauggagguccaggugaugcucgcggggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguucaccgucuccaucgaccagauguacaccagccucaacgaggugaucuccgugcagugccagaacgggcgcugcacccuggacggcgagcugcgggggacgacccagcuccaggucagcggcaucugcgccuucaagggcgaggugaccgcccacguccacgacaacgaccaccuguacaacgugaccaucacgaaccugaacgggucccccuucgaccccagcgaggacgugcccgccccgcucggcguccccgacuuccaggggcgcguguucggcaucaucucccagcgggacaagcacaacagccccgggcacaacgagccggcgaaccgcggccacgacgccgugguccccaccuacaccgcccaguacacccccaagcugggccagauccagaucgggacguggcagaccgacgaccugaccgugaaccagcccgugaaguucaccccggucggccucaacgacacggagcacuucaaccaguggguggugccccgguacgccggggcccugaaccugaacaccaaccucgcgcccagcgucgcccccguguucccgggcgagcgccugcuguucuuccgguccuacgugccccucaagggcggguacggcaaccccgccaucgacugccugcugccccaggaguggguccagcacuucuaccaggaggccgcgccgagcauguccgagguggcccucgugcgcuacaucaaccccgacaccgggcgggcccuguucgaggccaagcugcaccgcgccggcuucaugaccgucagcuccaacacgagcgcgcccguggugguccccgccaacggguacuuccgguucgacuccugggugaaccaguucuacagccucgccccgaugggcaccgggaacggccgccgccgggugcaguga

SEQ ID NO: 10038 - RNA, 1644 nt, Artificial Sequence
  derived and/or modified sequence opt1 from VP1__Norovirus__BAL14785
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagggcaucguggugcagccccagaacggccgcugcacccuggacgggacgcuccagggcaccacccagcuggucccgacccagaucugcgccuuccgggggacgcugaucggccagaccucccgcagcuccgacagcaccgacuccgcgccccggcgccgggaccacccccuccacgugcagcugaagaaccuggacggcacccaguacgacccgacggacgagguccccgccgugcucggggccaucgacuucaagggcaccguguucggggucgccagccagcgcgacguguccggccagcaggucggggccacccgggcccacgaggugcacaucagcaccacggacccccgcuacacccccaagcugggcagcauccugaugcgguccgagagcgacgacuucgugaccggccagccggugcgcuucacccccaucgggaugggcgacaacgacuggcaccagugggagcuccccgacuacuccgggcaccugacgcugaacaugaaccucgcccccgcggucgccccggccuuccccggcgagcgcauccuguucuuccggagcauggugcccuccgccgggggcuacggcagcgggcagaucgacugccugaucccccaggagugggugcagcacuucuaccaggaggcggccccgucccagagcgccgucgcccucauccgcuacgugaaccccgacaccggccggaacaucuucgaggccaagcugcaccgcgagggguucaucaccguggcgaacuccggcaacaaccccaucgucgugcccccgaacggguacuuccgguucgaggccugggugaaccaguucuacacccugacgcccaugggcaccggccaggggcgccggcgcaaccaguga

SEQ ID NO: 10039 - RNA, 1749 nt, Artificial Sequence
  derived and/or modified sequence opt1 from VP1__Norovirus__BAR88157
augaagauggccagcuccgacgccgcgagccccuccagcgacggcgccgccaaccuggugccggagaucaacaacgaggucauggcccucgagcccguggccggggcgcagcuggccgcccccguggccgaccaguucaacgcgaucgaccccuggauccgccagaacuucguccaggccccggagggcgaguucaccgugagcccccggaacgcccccggggagauccugcucaaccuggagcugggcccccaccucaacccguuccugcagcaccuggcccagauguacaacgccuacgccgggggcauggaggugcaggucgugcucgccggcaacgccuucaccgccgggaagaucaucuucgccgcgaucccgccccacuucccgcccgagcgccuguccgccgcccaggccacgcaguucccccacgugaucaucgacguccggcagcuggagcccaucgugcucccccugcccgacgugcgccacaaccuguuccacuucaaccagcagaacgacgagcggaugcgccucgucgccuuccuguacacgccccugcgggcgaacuccggcagcggggacgacguguucaccguguccugccgcguccucacccggcccagccccgacuucgaguucauguuccuggugccgcccaccguggagcgcaagaccgucgccuucucccugccccagcucaccgugggcgagaugagcaacucccgguggcccgcccgcaucaccacgaugaucgccgacccgcaccucccccaggugcugcggauccagaacgggcgcugcacccucgacggcacccugaugggcaccacgcagcugaaccccaacgacaucugccggguccgcggguacuucagcaacucccggccccaggugaugugcgagggcgaggacgacgcccucgaccaggcgagccugggggccgagccgauccgcgaccaggcccccggccugcggacccaggcccgcuccaccgagcggugguucgcggugaccgagcucaacggccaggccuacgaccccuucggggaccagccggcgccccugggcguccccgacuucgaggcccgcaucgugggggcccugguccgccuccccggcacgaacccgaccagcaacucccgguucgaggacgcguggaucgacaccaacaaccagaccacguacgcccccgccgccgggaugguggccaucaccaccagcgacgacagcuccagcaacuacgcgaacgaccaggugugcgaguuccugccccugggcgucgacaucaccaacuccacgcccuacaacgaguucgaccucccgagcuacggcggguccgccagcuccggcaaccgcaaccuggcccccaccguggcccccaccuuccccggggagaucgugcugcuguucggcagcaacaugccgguccagaaccgguccgccgggaccagcaacaaggagauccgcugccugcugcccaacgaguacauccagcaccucuacgacacgcaggcgcccucccugagcgacguggcccuggugcgguacaucaaccccgacaccggccgcguccucuucgaggccaagcugcaccgggacggcuucaugaccgugaacgccuccgcgaccacggugcugccggucgacgggcacuuccgcuucgacagcugggugaaccaguucuacgcccucucccccgugggcaacgccagcgggcggcgcggccggaaccgccgggucgacuga

SEQ ID NO: 10040 - RNA, 1623 nt, Artificial Sequence; identical to SEQ ID NO: 9441
  derived and/or modified sequence opt1 from VP1__Norovirus__BAS29993

SEQ ID NO: 10041 - RNA, 1623 nt, Artificial Sequence
  derived and/or modified sequence opt1 from VP1__Norovirus__BAS29996
augaagauggccagcaacgacgccacccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccgcaacuacaccaugaaccuggccagccugaacuggaacaacuacgaccccacggaggagaucccggcgccccucgggacccccgacuucgugggcaagauccaggggguccugacccagaccacgaagggcgacggguccacccggggccacaaggccaccguguacaccggcagcgcccccuucacgccgaagcuggggagcgugcaguucuccaccgacaccgagaacgacuucgagacccaccagaacacgaaguucacccccgucggcgugauccaggacgggggcaccacccaccgcaacgagccccagcagugggugcuccccagcuacuccgggcggaacgucccgaacgugcaccuggcccccgccguggcgcccacguuccccggcgagcagcuccucuucuuccgcagcaccaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacgcucgcccccaugggcaacggcaccgggcgccggcgcgcccuguga

SEQ ID NO: 10042 - RNA, 1623 nt, Artificial Sequence
  derived and/or modified sequence opt1 from VP1__Norovirus__BAS29999
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcgacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgagguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 10043 - RNA, 1623 nt, Artificial Sequence
  derived and/or modified sequence opt1 from VP1__Norovirus__BAS30005
augaagauggccagcaacgacgccaaccccuccgacggcagcgcggccaaccuggugccggaggucuccaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccggggccuucgugguccagccgcagaacggccgcugcacgaccgacggggugcugcugggcaccacccagcucagccccgucaacaucugcacguuccggggcgacgugacccacaucgccgggucccgcaacuacaccaugaaccuggccagccugaacuggaacaacuacgaccccaccgaggagaucccggcgccccucggcacgcccgacuucguggggaagauccagggcguccugacccagaccaccaagggggacggcuccacgcggggccacaaggccaccguguacaccgggagcgcccccuucaccccgaagcugggcagcgugcaguucuccacggacaccgagaacgacuucgagacccaccagaacaccaaguucacgcccgucggggugauccaggacggcagcaccacccaccgcaacgagccccagcagugggugcuccccuccuacagcgggcgggacguccacaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 10044 - RNA, 1623 nt, Artificial Sequence
  derived and/or modified sequence opt1 from VP1__Norovirus__BAS30008
augaagauggccagcaacgacgccaaccccuccgacggcagcgcggccaaccuggugccggaggucaacaacgaggugauggcccucgagcccguggucggggccgccaucgcggcccccguggccggccagaccaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcggggccuucgugguccagccgcagaacggccgcugcaccaccgacggggugcugcugggcaccacgcagcucucccccgucaacaucugcaccuuccggggcgacgugacccacaucgccgggagccgcaacuacaccaugaaccuggccucccugaacuggaacaacuacgaccccacggaggagaucccggcgccccucggcacccccgacuucguggggaagauccagggcguccugacccagaccacgaagggggacggcagcacccggggccacaaggccaccguguacaccggguccgcccccuucacgccgaagcugggcagcgugcaguucagcaccgacaccgagaacgacuucgaggcccaccagaacaccaaguucacgcccgucggggugauccaggacggcuccaccacccaccgcaacgagccccagcagugggugcuccccagcuacuccgggggcaacguccagaacgugcaccuggccccggcgguggcccccaccuuccccggcgagcagcuccucuucuuccggagcacgaugcccgggugcuccggcuacccgaacauggaccuggacugccugcucccccaggaguggguccagcacuucuaccaggaggccgcccccgcgcagagcgacguggcccugcugcgcuucgugaaccccgacaccgggcggguccucuucgagugcaagcugcacaaguccggcuacgugaccguggcccacaccgggcagcacgaccuggucaucccgcccaacggcuacuuccgcuucgacagcugggugaaccaguucuacacccucgcccccaugggcaacgggacgggccggcgccgggcccuguga

SEQ ID NO: 10045 - RNA, 1623 nt, Artificial Sequence; identical to SEQ ID NO: 9892
  derived and/or modified sequence opt1 from VP1__Norovirus__BAS30011

SEQ ID NO: 10046 - RNA, 1623 nt, Artificial Sequence
  derived and/or modified sequence opt1 from VP1__Norovirus__BAS30014
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaucuuccccggcgagcagcuccucuucuuccgcagcaccaugccgggcugcuccggguaccccaacauggaccuggacugccugcucccccaggaguggguccagcacuucuaccaggaggccgcccccgcccagagcgacguggcgcugcugcgguucgugaacccggacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggcgccggcgcgcccuguga

SEQ ID NO: 10047 - RNA, 1623 nt, Artificial Sequence
  derived and/or modified sequence opt1 from VP1__Norovirus__BAS30017
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccacguucgugguccagccgcagaacgggcgcugcaccaccgacggcgugcugcuggggaccacgcagcucagccccgucaacaucugcaccuuccggggcgacgugacccacaucgccggcucccgcaacuacaccaugaaccuggccagccugaacuggaacaacuacgaccccacggaggagaucccggcgccccucgggacccccgacuucgugggcaagauccaggggguccugacccagaccacgaagggcgacggguccacccggggccacaaggccaccguguacaccggcagcgcccccuucacgccgaagcuggggagcgugcaguucggcaccgacaccgagaacgacuucgagacccaccagaacacgaaguucacccccgucggggugauccaggacggcgggaccacccaccgcaacgagccccagcagugggugcuccccuccuacagcggccggaacgucccgaacgugcaccuggcccccgccguggcccccacguuccccggcgagcagcuccucuucuuccgcuccaccaugccggggugcagcggcuaccccaacauggaccuggacugccugcucccccaggaguggguccagcacuucuaccaggaggcggcccccgcccaguccgacguggcccugcugcgguucgugaacccggacaccgggcgcguccucuucgagugcaagcugcacaagagcggcuacgugaccguggcgcacaccgggcagcacgaccuggucaucccgcccaacggcuacuuccgguucgacuccugggugaaccaguucuacacgcucgcccccaugggcaacgggaccggccgccggcgcgcccuguga

SEQ ID NO: 10048 - RNA, 1623 nt, Artificial Sequence
  derived and/or modified sequence opt1 from VP1__Norovirus__BAS30023
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgaucgaggggcugagccccucccaggugacgauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucaccguccccauccugacgguggaggagaugaccaacucccgguuccccaucccccuggagaagcuguucaccggccccagcuccgccuucgugguccagccgcagaacgggcgcugcaccacggacggcgugcugcuggggaccacccagcucagccccgucaacaucugcaccuuccggggcgacgugacgcacaucgccggcucccgcaacuacaccaugaaccuggccagccugaacuggaacaacuacgaccccaccgaggagaucccggcgccccucgggacccccgacuucgugggcaagauccaggggguccugacgcagaccaccaagggcgacggguccacccggggccacaaggccacgguguacaccggcagcgcccccuucaccccgaagcuggggagcgugcaguucuccaccgacacggagaacgacuucgagacccaccagaacaccaaguucacccccgucggcgugauccaggacgggggcacgacccaccgcaacgagccccagcagugggugcuccccagcuacuccgggcggaacgucccgaacgugcaccuggcccccgccguggcgcccaccuuccccggcgagcagcuccucuucuuccgcagcaccaugccgggcugcuccggguaccccaacauggaccuggacugccugcucccccaggaguggguccagcacuucuaccaggaggccgcccccgcccagagcgacguggcgcugcugcgguucgugaacccggacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggcgccggcgcgcccuguga

SEQ ID NO: 10049 - RNA, 1623 nt, Artificial Sequence; identical to SEQ ID NO: 9927
  derived and/or modified sequence opt1 from VP1__Norovirus__BAS30026

SEQ ID NO: 10050 - RNA, 1623 nt, Artificial Sequence
  derived and/or modified sequence opt1 from VP1__Norovirus__BAS30029
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacguccacaacgugcaccuggccccggccguggcgcccaccuuccccggcgagcagcuccucuucuuccgcuccacgaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 10051 - RNA, 1623 nt, Artificial Sequence
  derived and/or modified sequence opt1 from VP1__Norovirus__BAS30035
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucggcacggacaccgagaacgacuucgagacccaccagaacaccaaguucacgcccgucggggugauccaggacggcgggaccacccaccgcaacgagccccagcagugggugcuccccuccuacagcggccggaacgucccgaacgugcaccuggcccccgccguggcgcccaccuuccccggcgagcagcuccucuucuuccgcuccacgaugccggggugcagcggcuaccccaacauggaccuggacugccugcucccccaggaguggguccagcacuucuaccaggaggccgcccccgcccaguccgacguggcgcugcugcgguucgugaacccggacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcgcccuguga

SEQ ID NO: 10052 - RNA, 1623 nt, Artificial Sequence; identical to SEQ ID NO: 10051
  derived and/or modified sequence opt1 from VP1__Norovirus__BAS30038

SEQ ID NO: 10053 - RNA, 1623 nt, Artificial Sequence; identical to SEQ ID NO: 10048
  derived and/or modified sequence opt1 from VP1__Norovirus__BAS30041

SEQ ID NO: 10054 - RNA, 1623 nt, Artificial Sequence
  derived and/or modified sequence opt1 from VP1__Norovirus__BAS30044
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgagccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcccccaccuuccccggcgagcagcuccucuucuuccgcagcacgaugccgggcugcuccggguaccccaacauggaccuggacugccugcucccccaggaguggguccagcacuucuaccaggaggcggcccccgcccagagcgacguggcccugcugcgguucgugaacccggacaccggccgcguccucuucgagugcaagcugcacaaguccggguacgugaccguggcgcacaccggccagcacgaccuggucaucccgcccaacggguacuuccgguucgacagcugggugaaccaguucuacacccucgcccccaugggcaacggcacggggcgccggcgcgcccuguga

SEQ ID NO: 10055 - RNA, 1623 nt, Artificial Sequence; identical to SEQ ID NO: 10046
  derived and/or modified sequence opt1 from VP1__Norovirus__BAS30047

SEQ ID NO: 10056 - RNA, 1623 nt, Artificial Sequence; identical to SEQ ID NO: 9441
  derived and/or modified sequence opt1 from VP1__Norovirus__BAS30050

SEQ ID NO: 10057 - RNA, 1623 nt, Artificial Sequence
  derived and/or modified sequence opt1 from VP1__Norovirus__BAS30053
augaagauggccagcaacgacgccacccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccgcaacuacaccaugaaccuggccagccugaacuggaacaacuacgaccccacggaggagaucccggcgccccucgggacccccgacuucgugggcaagauccaggggguccugacccagaccacgaagggcgacggguccacccggggccacaaggccaccguguacaccggcagcgcccccuucacgccgaagcuggggagcgugcaguucaacaccgacaccgagaacgacuucgagacccaccagaacacgaaguucacccccgucggcgugauccaggacggguccaccacccaccgcaacgagccccagcagugggugcuccccagcuacuccggccggaacgucccgaacgugcaccuggcccccgccguggcgcccacguuccccggggagcagcuccucuucuuccgcagcaccaugccgggcugcuccggcuaccccaacauggaccuggacugccugcucccccaggaguggguccagcacuucuaccaggaggccgcccccgcccagagcgacguggcgcugcugcgguucgugaacccggacaccgggcgcguccucuucgagugcaagcugcacaaguccggcuacgugaccguggcccacaccgggcagcacgaccuggucaucccgcccaacggcuacuuccgguucgacagcugggugaaccaguucuacacgcucgcccccauggggaacggcaccggccgccggcgcgcccuguga

SEQ ID NO: 10058 - RNA, 1623 nt, Artificial Sequence; identical to SEQ ID NO: 10048
  derived and/or modified sequence opt1 from VP1__Norovirus__BAS30056

SEQ ID NO: 10059 - RNA, 1623 nt, Artificial Sequence
  derived and/or modified sequence opt1 from VP1__Norovirus__BAS30059
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccaggacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 10060 - RNA, 1623 nt, Artificial Sequence; identical to SEQ ID NO: 9967
  derived and/or modified sequence opt1 from VP1__Norovirus__BAS30062

SEQ ID NO: 10061 - RNA, 1623 nt, Artificial Sequence
  derived and/or modified sequence opt1 from VP1__Norovirus__BAS30065
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccguggugaagacgacccugagcgccgucccgcccaacuucccgaccgagggccugucccccagccaggugaccauguucccccacaucaucguggacguccggcagcucgagcccgugcugaucccgcugcccgacgugcgcaacaacuucuaccacuacaaccaguccaacgacagcacgaucaagcucaucgccaugcuguacacgccccugcgggccaacaacgccggggaggacgucuucaccguguccugccgcgugcucacccggcccagcccggacuucgacuucaucuuccuggucccgcccaccguggagucccgcaccaagcccuucaccgugcccauccugaccgucgaggagaugacgaacagccgguuccccaucccccucgagaagcuguucaccggccccuccagcgcguucgugguccagccgcagaacggccgcugcaccaccgacggggugcugcucggcacgacccagcugucccccgugaacaucugcaccuuccgcggggacgucacccacaucgccggcagccggaacuacacgaugaaccuggccucccucaacuggaacaacuacgaccccaccgaggagaucccggcgccccugggcacccccgacuucguggggaagauccagggcgugcugacccagacgaccaagggggacggcagcacccgggggcacaaggccaccgucuacacgggcagcgcccccuucaccccgaagcucggcuccgugcaguucagcaccgacaccgagaacgacuucgagacgcaccagaacaccaaguucacccccgugggggucauccaggacggcgggaccacgcaccgcaacgagccccagcagugggugcugcccuccuacagcggccggaacgugccgaacguccaccuggcccccgccguggcccccaccuuccccggggagcagcuccuguucuuccgcuccaccaugccgggcugcagcggcuaccccaacauggaccuggacugccuccugccccaggagugggugcagcacuucuaccaggaggccgcgcccgcccaguccgacgucgcccugcuccgguucgugaacccggacaccgggcgcgugcuguucgagugcaagcugcacaagagcggcuacgucaccguggcccacacggggcagcacgaccucgugaucccgcccaacggcuacuuccgguucgacuccugggucaaccaguucuacacccuggcgcccauggggaacggcaccggccgccggcgcgcccuguga

SEQ ID NO: 10062 - RNA, 1623 nt, Artificial Sequence
  derived and/or modified sequence opt1 from VP1__Norovirus__BAS30068
augaagauggccagcaacgacgccaccgcguccgacggcagcgccgccaaccuggugcccgaggucaacaacgaggugauggcccucgagccgguggucggggccgcgaucgccgcccccguggccggccagcagaacgugaucgaccccuggauccgcaacaacuucguccaggcgcccgggggcgaguucaccguguccccgcggaacgcccccggggagauccuguggagcgcgccccugggccccgaccucaacccguaccugucccaccuggcccgcauguacaacggcuacgccgggggcuucgaggugcaggucauccucgccgggaacgccuucacggccggcaagaucaucuucgccgccgugccgcccaacuuccccaucgaggggcugagccccucccaggugaccauguucccccacaucaucgucgacgugcggcagcuggagcccgugcucaucccccugccggacguccgcaacaacuucuaccacuacaaccagagcaacgacuccaccaucaagcugaucgcgaugcucuacacgccccugcgggccaacaacgccggcgaggacguguucaccgugagcugccgcguccugacccggcccucccccgacuucgacuucaucuuccucgugccgcccaccguggagagccgcaccaagcccuucacgguccccauccugaccguggaggagaugaccaacucccgguucccgaucccccuggagaagcuguucaccggccccagcuccgccuucgugguccagccccagaacgggcgcugcacgaccgacggcgugcugcuggggaccacccagcucagcccggucaacaucugcacguuccggggcgacgugacccacaucgccggcucccgcaacuacaccaugaaccuggcgagccugaacuggaacaacuacgaccccaccgaggagauccccgccccgcucgggacgcccgacuucgugggcaagauccaggggguccugacccagaccaccaagggcgacggguccacgcggggccacaaggccaccguguacaccggcagcgcccccuucacccccaagcuggggagcgugcaguucuccacggacaccgagaacgacuucgagacccaccagaacaccaaguucacgccggucggcgugauccaggacgggggcaccacccaccgcaacgagccccagcagugggugcuccccagcuacuccgggcggaacguccccaacgugcaccuggccccggcgguggcccccaccuuccccggcgagcagcuccucuucuuccgcagcacgaugcccggcugcuccggguacccgaacauggaccuggacugccugcucccccaggaguggguccagcacuucuaccaggaggccgcccccgcgcagagcgacguggcccugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 10063 - RNA, 1623 nt, Artificial Sequence; identical to SEQ ID NO: 10048
  derived and/or modified sequence opt1 from VP1__Norovirus__BAS30071

SEQ ID NO: 10064 - RNA, 1623 nt, Artificial Sequence; identical to SEQ ID NO: 10048
  derived and/or modified sequence opt1 from VP1__Norovirus__BAS30074

SEQ ID NO: 10065 - RNA, 1623 nt, Artificial Sequence
  derived and/or modified sequence opt1 from VP1__Norovirus__BAS30077
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccacaacuacaccaugaaccuggccagccugaacuggaacaacuacgaccccaccgaggagaucccggcgccccucgggacgcccgacuucgugggcaagauccaggggguccugacccagaccaccaagggcgacggguccacgcgcggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccgcccaccggaacgagccccagcagugggugcuccccagcuacuccgggcgcaacguccagaacgugcaccuggccccggcgguggcccccaccuuccccggcgagcagcuccucuucuuccggagcaccaugcccggcugcuccggguacccgaacauggaccuggacugccugcucccccaggaguggguccagcacuucuaccaggaggccgcccccgcgcagagcgacguggcccugcugcgcuucgugaaccccgacacgggccggguccucuucgagugcaagcugcacaaguccggguacgugaccguggcccacaccggccagcacgaccuggucaucccgcccaacggguacuuccgcuucgacagcugggugaaccaguucuacacccucgcccccaugggcaacggcaccgggcggcgccgggcccuguga

SEQ ID NO: 10066 - RNA, 1623 nt, Artificial Sequence
  derived and/or modified sequence opt1 from VP1__Norovirus__BAS30080
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggccagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 10067 - RNA, 1623 nt, Artificial Sequence; identical to SEQ ID NO: 9441
  derived and/or modified sequence opt1 from VP1__Norovirus__BAS30083

SEQ ID NO: 10068 - RNA, 1623 nt, Artificial Sequence
  derived and/or modified sequence opt1 from VP1__Norovirus__BAS30086
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccgugcugaccguggaggagaugaccaacucccgguuccccaucccccuggagaagcuguucaccggccccagcuccgccuucgucgugcagccgcagaacgggcgcugcacgaccgacggcguccugcuggggaccacccagcucagccccgugaacaucugcacguuccggggcgacgugacccacaucgccaacucccacaacuacaccaugaaccuggccagccugaacuggaacaacuacgaccccaccgaggagaucccggcgccccucggcacgcccgacuucgucgggaagauccagggcgugcugacccagaccaccaagggggacggcuccacgcgcgggcacaaggccaccguguacaccggcagcgcccccuucaccccgaagcugggcagcguccaguucuccacggacaccgagaacgacuucgagacccaccagaacaccaaguucacgcccgugggggugauccaggacggcgggaccacccaccggaacgagccccagcaguggguccuccccagcuacuccggccgcaacgugcagaacgugcaccuggccccggccgucgcgcccaccuuccccggggagcagcuccucuucuuccggagcacgaugcccggcugcuccggcuacccgaacauggaccuggacugccugcucccccaggagugggugcagcacuucuaccaggaggccgcccccgcccagagcgacguggcgcugcugcgcuucgucaaccccgacaccgggcggguccucuucgagugcaagcugcacaaguccggcuacgugaccguggcccacaccgggcagcacgaccuggugaucccgcccaacggcuacuuccgcuucgacagcugggugaaccaguucuacacccucgcccccauggggaacggcacgggccggcgccgggcccuguga

SEQ ID NO: 10069 - RNA, 1623 nt, Artificial Sequence
  derived and/or modified sequence opt1 from VP1__Norovirus__BAS30089
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucuccaucugcacguuccggggcgacgugacccacaucgccggcagccgcgacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacggguccaccgcccaccgcaacgagccccagcagugggugcuccccagcuacuccggccggaacguccagaacgugcaccuggccccggcgguggcccccaccuuccccggggagcagcuccucuucuuccgcagcaccaugcccggcugcuccggcuacccgaacauggaccuggacugccugcucccccaggaguggguccagcacuucuaccaggaggccgcccccgcgcagagcgacguggcccugcugcgguucgugaaccccgacacggggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcaccggccgccggcgcgcccuguga

SEQ ID NO: 10070 - RNA, 1623 nt, Artificial Sequence
  derived and/or modified sequence opt1 from VP1__Norovirus__BAS30092
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgaucgaggggcugagccccucccaggugacgauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucaccguccccauccugacgguggaggagaugaccaacucccgguuccccaucccccuggagaagcuguucaccggccccagcuccgccuucgugguccagccgcagaacgggcgcugcaccacggacggcgugcugcuggggaccacccagcucagccccgucaacaucugcaccuuccggggcgacgugacgcacaucgccuccagccgcaacuacaccaugaaccuggccucccugaacuggaacaacuacgaccccaccgaggagaucccggcgccccucggcacccccgacuucguggggaagauccagggcguccugacgcagaccaccaagggggacggcagcacccgggggcacaaggccacgguguacaccggcagcgcccccuucaccccgaagcugggcuccgugcaguucagcaccgacacggagaacgacuucgagacccaccagaacaccaaguucacccccgucggggugauccaggacggcgggacgacccaccgcaacgagccccagcagugggugcuccccuccuacagcggccggaacgucccgaacgugcaccuggcccccgccguggcgcccaccuuccccggggagcagcuccucuucuuccgcuccaccaugccgggcugcagcggcuaccccaacauggaccuggacugccugcucccccaggaguggguccagcacuucuaccaggaggccgcccccgcccaguccgacguggcgcugcugcgguucgugaacccggacacggggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcaccggccgccggcgcgcccuguga

SEQ ID NO: 10071 - RNA, 1623 nt, Artificial Sequence
  derived and/or modified sequence opt1 from VP1__Norovirus__BAS30095
augaagauggccagcaacgacgccaaccccuucgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccggccgaggggcugucccccagccaggugacgauguucccccacaucaucgucgacgugcggcagcuggagcccgugcucaucccgcugcccgacguccgcaacaacuucuaccacuacaaccaguccaacgacagcaccaucaagcugaucgcgaugcucuacacgccccugcgggccaacaacgccggcgaggacguguucaccguguccugccgcguccugacccggcccagcccggacuucgacuucaucuuccucgugccgcccaccguggagucccgcaccaagcccuucaccguccccauccugacgguggaggagaugaccaacagccgguuccccaucccccuggagaagcuguucaccggccccuccagcgccuucgugguccagccgcagaacgggcgcugcaccacggacggcgugcugcuggggaccacccagcucucccccgucaacaucugcaccuuccggggcgacgugacgcacaucgccggcagccgcaacuacaccaugaaccuggcgucccugaacuggaacaacuacgaccccaccgaggagaucccggcgccccucgggacccccgacuucgugggcaagauccaggggguccugacgcagaccaccaagggcgacgggagcacccggggccacaaggccacgguguacaccggcuccgcccccuucaccccgaagcuggggagcgugcaguucagcaccgacacggagaacgacuucgagacccaccagaacaccaaguucacccccgucggcgugauccaggacgggggcacgacccaccgcaacgagccccagcagugggugcuccccuccuacagcgggcggaacgucccgaacgugcaccuggcccccgccguggcccccaccuuccccggcgagcagcuccucuucuuccgcuccaccaugccgggcugcagcggguaccccaacauggaccuggacugccugcucccccaggaguggguccagcacuucuaccaggaggccgcccccgcgcaguccgacguggcccugcugcgguucgugaacccggacacgggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcaccgggcgccggcgcgcccuguga

SEQ ID NO: 10072 - RNA, 1623 nt, Artificial Sequence
  derived and/or modified sequence opt1 from VP1__Norovirus__BAS30098
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucaucgugcagccgcagaacgggcgcugcacgaccgacggcguccugcuggggaccacccagcucagccccgugaacaucugcacguuccggggcgacgucacccacaucgccggcucccgcaacuacaccaugaaccuggccagccugaacuggaacaacuacgaccccaccgaggagaucccggcgccccucgggacgcccgacuucgugggcaagauccagggggugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggggcaccacccaccgcaacgagccccagcagugggugcuccccagcuacuccgggcggaacgugccgaacguccaccuggcccccgccguggcgcccaccuuccccggcgagcagcuccucuucuuccgcagcacgaugccgggcugcuccggguaccccaacauggaccuggacugccugcucccccaggagugggugcagcacuucuaccaggaggccgcccccgcccagagcgacgucgcgcugcugcgguucgugaacccggacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcacggggcgccggcgcgcccuguga

SEQ ID NO: 10073 - RNA, 1623 nt, Artificial Sequence
  derived and/or modified sequence opt1 from VP1__Norovirus__BAS30101
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccgcccaccgcaacgagccccagcagugggugcuccccuccuacagcggccggaacguccagaacgugcaccuggccccggcgguggcccccaccuuccccggggagcagcuccucuucuuccgcuccaccaugcccggcugcagcggcuacccgaacauggaccuggacugccugcucccccaggaguggguccagcacuucuaccaggaggccgcccccgcgcaguccgacguggcccugcugcgguucgugaaccccgacacggggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcaccggccgccggcgcgcccuguga

SEQ ID NO: 10074 - RNA, 1623 nt, Artificial Sequence
  derived and/or modified sequence opt1 from VP1__Norovirus__BAS30104
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcgacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacgccaaguucacccccgucggcgugauccaggacgggagcacgacccaccgcaacgagccccagcagugggugcuccccuccuacagcggccggaacgucccgaacgugcaccuggcccccgcgguggcccccaccuuccccggggagcagcuccucuucuuccgcuccaccaugccgggcugcagcggcuaccccaacauggaccuggacugccugcucccccaggaguggguccagcacuucuaccaggaggccgcccccgcgcaguccgacguggcccugcugcgguucgugaacccggacacggggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcaccggccgccggcgcgcccuguga

SEQ ID NO: 10075 - RNA, 1623 nt, Artificial Sequence
  derived and/or modified sequence opt1 from VP1__Norovirus__BAS30107
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccacaacuacaccaugaaccuggccagccugaacuggaacaacuacgaccccacggaggagaucccggcgccccucgggacccccgacuucgugggcaagauccaggggguccugacccagaccacgaagggcgacggguccacccgcggccacaaggccaccguguacaccggcagcgcccccuucacgccgaagcuggggagcgugcaguucuccaccgacaccgagaacgacuucgagacccaccagaacacgaaguucacccccgucggcgugauccaggacgggggcaccacccaccggaacgagccccagcagugggugcuccccagcuacuccgggcgcaacguccagaacgugcaccuggccccggccguggcccccacguuccccggcgagcagcuccucuucuuccggagcaccaugcccggcugcuccggguacccgaacauggaccuggacugccugcucccccaggaguggguccagcacuucuaccaggaggcggcccccgcccagagcgacguggcccugcugcgcuucgugaaccccgacaccggccggguccucuucgagugcaagcugcacaaguccggguacgugaccguggcgcacaccggccagcacgaccuggucaucccgcccaacggguacuuccgcuucgacagcugggugaaccaguucuacacgcucgcccccaugggcaacggcaccgggcggcgccgggcccuguga

SEQ ID NO: 10076 - RNA, 1623 nt, Artificial Sequence; identical to SEQ ID NO: 10048
  derived and/or modified sequence opt1 from VP1__Norovirus__BAS30110

SEQ ID NO: 10077 - RNA, 1623 nt, Artificial Sequence; identical to SEQ ID NO: 9441
  derived and/or modified sequence opt1 from VP1__Norovirus__BAS30113

SEQ ID NO: 10078 - RNA, 1623 nt, Artificial Sequence
  derived and/or modified sequence opt1 from VP1__Norovirus__BAS30116
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcgacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcgcuucuccacggacaccgagaacgacuucgagauccaccagaacaccaaguucacccccgugggcgucauccaggacgggagcacgacccaccggaacgagccccagcagugggugcuccccuccuacagcggccgcgacgcccacaacgugcaccuggccccggcggucgcccccaccuuccccggggagcagcuccucuucuuccgguccaccaugcccggcugcagcggcuacccgaacauggaccuggacugccugcucccccaggagugggugcagcacuucuaccaggaggccgcccccgcgcaguccgacguggcccugcugcgcuucgucaaccccgacacggggcggguccucuucgagugcaagcugcacaagagcggcuacgugaccguggcccacaccgggcagcacgaccuggugaucccgcccaacggcuacuuccgcuucgacuccugggugaaccaguucuacacccucgcccccauggggaacggcaccggccggcgccgcgcccuguga

SEQ ID NO: 10079 - RNA, 1623 nt, Artificial Sequence; identical to SEQ ID NO: 10048
  derived and/or modified sequence opt1 from VP1__Norovirus__BAS30119

SEQ ID NO: 10080 - RNA, 1623 nt, Artificial Sequence
  derived and/or modified sequence opt1 from VP1__Norovirus__BAS30125
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcgacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcgcuucuccacggacaccgagaacgacuucgagauccaccagaacaccaaguucacccccgugggcgucauccaggacgggagcacgacccaccggaacgagccccagcagugggugcuccccuccuacagcggccgcgacgcccacaacgugcaccuggccccggcggucgcccccaccuuccccggggagcagcuccucuucuuccgguccaccaugcccggcugcagcggcuacccgaacauggaccuggacugccugcucccccaggagugggugcagcacuucuaccaggaggccgcccccgcgcaguccgacguggcccugcugcgcuucgucaaccccgacacggggcggguccucuucgagugcaagcugcacaagagcggcuacgugaccguggcccacaccgggcagcacgaccuggugaucccgcccaacggcuacuuccgcuucgacuccugggugaaccaguucuacacccucgcccccauggggaacggcaccggccggcgccgcguccuguga

SEQ ID NO: 10081 - RNA, 1623 nt, Artificial Sequence; identical to SEQ ID NO: 9441
  derived and/or modified sequence opt1 from VP1__Norovirus__BAS30128

SEQ ID NO: 10082 - RNA, 1623 nt, Artificial Sequence
  derived and/or modified sequence opt1 from VP1__Norovirus__BAS30134
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggagcaccacccaccgcaacgagccccagcagugggugcuccccuccuacagcggccgggacgugccgaacguccaccuggcccccgccguggcgcccaccuuccccggggagcagcuccucuucuuccgcuccacgaugccgggcugcagcggcuaccccaacauggaccuggacugccugcucccccaggagugggugcagcacuucuaccaggaggccgcccccgcccaguccgacgucgcgcugcugcgguucgugaacccggacaccgggcgcguccucuucgagugcaagcugcacaagagcggcuacgugaccguggcccacaccgggcagcacgaccuggugaucccgcccaacggcuacuuccgguucgacuccugggucaaccaguucuacacccucgcccccauggggaacggcacgggccgccggcgcgcccuguga

SEQ ID NO: 10083 - RNA, 1623 nt, Artificial Sequence; identical to SEQ ID NO: 9441
  derived and/or modified sequence opt1 from VP1__Norovirus__BAS30137

SEQ ID NO: 10084 - RNA, 1623 nt, Artificial Sequence; identical to SEQ ID NO: 9441
  derived and/or modified sequence opt1 from VP1__Norovirus__BAS30140

SEQ ID NO: 10085 - RNA, 1623 nt, Artificial Sequence
  derived and/or modified sequence opt1 from VP1__Norovirus__BAS30146
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgaucgaggggcugagccccucccaggugacgauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucaccguccccauccugacgguggaggagaugaccaacucccgguuccccaucccccuggagaagcuguucaccggccccagcuccgccuucgugguccagccgcagaacgggcgcugcaccacggacggcgugcugcuggggaccacccagcucagccccgucaacaucugcaccuuccggggcgacgugacgcacaucgccggcucccacaacuacaccaugagccuggccucccugaacuggaacaacuacgaccccaccgaggagaucccggcgccccucgggacccccgacuucgugggcaagauccaggggguccugacgcagaccaccaagggcgacgggagcacccgcggccacaaggccacgguguacaccggcagcgcccccuucaccccgaagcugggguccgugcaguucagcaccgacacggagaacgacuucgagacccaccagaacaccaaguucacccccgucggcgugauccaggacgggggcacgacccaccggaacgagccccagcagugggugcuccccuccuacagcgggcgcaacgucccgaacgugcaccuggcccccgccguggcgcccaccuuccccggcgagcagcuccucuucuuccgguccaccaugccgggcugcagcggguaccccaacauggaccuggacugccugcucccccaggaguggguccagcacuucuaccaggaggccgcccccgcccaguccgacguggcgcugcugcgcuucgugaacccggacacgggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacggcaccgggcggcgccgggcccuguga

SEQ ID NO: 10086 - RNA, 1623 nt, Artificial Sequence
  derived and/or modified sequence opt1 from VP1__Norovirus__BAS30149
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacgucccgaacgugcaccuggcccccgccguggcgcccaccuuccccggggagcagcuccucuucuuccgcuccacgaugccgggcugcagcggcuaccccaacauggaccuggacugccugcucccccaggaguggguccagcacuucuaccaggaggccgcccccgcccaguccgacguggcgcugcugcgguucgugaacccggacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcgcccuguga

SEQ ID NO: 10087 - RNA, 1623 nt, Artificial Sequence; identical to SEQ ID NO: 9441
  derived and/or modified sequence opt1 from VP1__Norovirus__BAS30152

SEQ ID NO: 10088 - RNA, 1623 nt, Artificial Sequence
  derived and/or modified sequence opt1 from VP1__Norovirus__BAS30155
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguucaagggcgacgugacccacaucgccgggagccggaacuacaccaugaaccuggccucccugaacuggaacaacuacgaccccaccgaggagaucccggcgccccucggcacgcccgacuucguggggaagauccagggcguccugacccagaccaccaagggggacggcagcacgcgcggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccagaacgagccccagcagugggugcuccccuccuacagcggccgggacgucccgaacgugcaccuggcccccgccguggcgcccaccuuccccggcgagcagcuccucuucuuccgcuccacgaugccggggugcagcggcuaccccaacaugaaccuggacugccugcucccccaggaguggguccagcacuucuaccaggaggccgcccccgcccaguccgacguggcgcugcugcgguucgugaacccggacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccaugggcaacgggacgggccgccggcgcgcccuguga

SEQ ID NO: 10089 - RNA, 1623 nt, Artificial Sequence
  derived and/or modified sequence opt1 from VP1__Norovirus__BAS30158
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgaucgaggggcugagccccucccaggugacgauguucccccacaucaucgucgacgugcggcagcuggagcccgugcucaucccgcugcccgacguccgcaacaacuucuaccacuacaaccagcugaacgacagcaccaucaagcucaucgccaugcuguacacgccccugcgggcgaacaacgccggcgaggacguguucaccguguccugccgcguccucacccggcccagcccggacuucgacuucaucuuccuggugccgcccaccguggagucccgcaccaagcccuucaccguccccauccugacgguggaggagaugaccaacagccgguuccccaucccccucgagaagcuguucaccggccccuccagcgccuucgugguccagccgcagaacgggcgcugcaccacggacggcgugcugcucgggaccacccagcugucccccgucaacaucugcaccuuccggggcgacgugacgcacaucgccggcagccgcaacuacaccaugucccuggccagccucaacuggaacaacuacgaccccaccgaggagaucccggcgccccuggggacccccgacuucgugggcaagauccaggggguccugacgcagaccaccaagggcgacggguccacccggggccacaaggccacgguguacaccggcagcgcccccuucaccccgaagcucgggagcgugcaguucuccaccgacacggagaacgacuucgagacccaccagaacaccaaguucacccccgucggcgugauccaggacgggggcacgacccaccgcaacgagccccagcagugggugcugcccagcuacuccgggcggaacgucccgaacgugcaccuggcccccgccguggcgcccaccuuccccggcgagcagcuccuguucuuccgcagcaccaugccgggcugcuccggguaccccaacauggaccuggacugccuccugccccaggaguggguccagcacuucuaccaggaggccgcccccgcccagagcgacguggcgcugcuccgguucgugaacccggacacgggccgcguccuguucgagugcaagcugcacaaguccggguacgugaccguggcccacaccggccagcacgaccucgucaucccgcccaacggguacuuccgguucgacagcugggugaaccaguucuacacccuggcccccaugggcaacggcaccgggcgccggcgcgcccuguga

SEQ ID NO: 10090 - RNA, 1623 nt, Artificial Sequence
  derived and/or modified sequence opt1 from VP1__Norovirus__BAS30164
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgaucgaggggcugagccccucccaggugacgauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucaccguccccauccugacgguggaggagaugaccaacucccgguuccccaucccccuggagaagcuguucaccggccccagcuccgccuucgugguccagccgcagaacgggcgcugcaccacggacggcgugcugcuggggaccacccagcucagccccgucaacaucugcaccuuccggggcgacgugacgcacaucgccggcucccgcaacuacaccaugagccuggccucccugaacuggaacaacuacgaccccaccgaggagaucccggcgccccucgggacccccgacuucgugggcaagauccaggggguccugacgcagaccaccaagggcgacgggagcacccggggccacaaggccacgguguacaccggcagcgcccccuucaccccgaagcugggguccgugcaguucagcaccgacacggagaacgacuucgagacccaccagaacaccaaguucacccccgucggcgugauccaggacgggggcacgacccaccgcaacgagccccagcagugggugcuccccuccuacagcgggcggaacgucccgaacgugcaccuggcccccgccguggcgcccaccuuccccggcgagcagcuccucuucuuccgcuccaccaugccgggcugcagcggguaccccaacauggaccuggacugccugcucccccaggaguggguccagcacuucuaccaggaggccgcccccgcccaguccgacguggcgcugcugcgguucgugaacccggacacgggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcaccgggcgccggcgcgcccuguga

SEQ ID NO: 10091 - RNA, 1623 nt, Artificial Sequence; identical to SEQ ID NO: 10086
  derived and/or modified sequence opt1 from VP1__Norovirus__BAS30167

SEQ ID NO: 10092 - RNA, 1623 nt, Artificial Sequence; identical to SEQ ID NO: 9441
  derived and/or modified sequence opt1 from VP1__Norovirus__BAS30170

SEQ ID NO: 10093 - RNA, 1623 nt, Artificial Sequence
  derived and/or modified sequence opt1 from VP1__Norovirus__BAS30173
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccaguacgaccuggucaucccgcccaacggguacuuccgguucgacagcugggugaaccaguucuacacccucgcccccaugggcaacggcacggggcgccggcgcgcccuguga

SEQ ID NO: 10094 - RNA, 1623 nt, Artificial Sequence
  derived and/or modified sequence opt1 from VP1__Norovirus__BAS30176
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagacccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcacgaagcccuucaccguccccauccugaccguggaggagaugaccaacucccgguuccccaucccccuggagaagcuguucacgggccccagcuccgccuucgugguccagccgcagaacgggcgcugcaccaccgacggcgugcugcuggggaccacgcagcucagccccgucaacaucugcaccuuccggggcgacgugacccacaucgccggcucccgcaacuacaccaugaaccuggccagccugaacuggaacaacuacgaccccacggaggagaucccggcgccccucgggacccccgacuucgugggcaagauccaggggaugcugacccagaccacgaagggcgacggguccacccggggccacaaggccaccgucuacaccggcagcgcccccuucacgccgaagcuggggagcgugcaguucuccaccgacaccgagaacgacuucgagacccaccagaacacgaaguucacccccgugggcgucauccaggacgggagcaccacccaccgcaacgagccccagcagugggugcuccccuccuacagcggccggaacgugccgaacguccaccuggcccccgccguggcgcccacguuccccggggagcagcuccucuucuuccgcuccaccaugccgggcugcagcggcuaccccaacauggaccuggacugccugcucccccaggagugggugcagcacuucuaccaggaggccgcccccgcccaguccgacgucgcgcugcugcgguucgugaacccggacaccgggcgcguccucuucgagugcaagcugcacaagagcggcuacgugaccguggcccacaccgggcagcacgaccuggugaucccgcccaacggcuacuuccgguucgacuccugggucaaccaguucuacacgcucgcccccauggggaacggcaccggccgccggcgcgcccuguga

SEQ ID NO: 10095 - RNA, 1623 nt, Artificial Sequence
  derived and/or modified sequence opt1 from VP1__Norovirus__BAS30179
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggccuccugcucgggaccacccagcugagccccgugaacaucugcacguuccggggcgacgucacccacaucgccggcucccgcaacuacaccaugaaccuggccagccucaacuggaacaacuacgaccccaccgaggagaucccggcgccccuggggacgcccgacuucgugggcaagauccaggggaugcugacccagaccaccaagggcgacggguccacgcggggccacaaggccaccguguacaccggcagcgcccccuucaccccgaagcucgggagcguccaguucuccacggacaccgagaacgacuucgagacccaccagaacaccaaguucacgcccgugggcgugauccaggacgggagcaccacccaccgcaacgagccccagcaguggguccugcccuccuacagcggccggaacgugccgaacgugcaccuggcccccgccgucgcgcccaccuuccccggggagcagcuccuguucuuccgcuccacgaugccgggcugcagcggcuaccccaacauggaccuggacugccuccugccccaggagugggugcagcacuucuaccaggaggccgcccccgcccaguccgacguggcgcugcuccgguucgucaacccggacaccgggcgcgugcuguucgagugcaagcugcacaagagcggcuacgugaccgucgcccacaccgggcagcacgaccucgugaucccgcccaacggcuacuuccgguucgacuccugggugaaccaguucuacacccuggcccccauggggaacggcacgggccgccggcgcgcccuguga

SEQ ID NO: 10096 - RNA, 1623 nt, Artificial Sequence
  derived and/or modified sequence opt1 from VP1__Norovirus__BAS30182
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcgacuacaccaugaaccuggccucccugaacuggaacaacuacgaccccaccgaggagaucccggcgccccucgggacgcccgacuucgugggcaagauccaggggaugcugacccagaccaccaagggcgacgggagcacgcggggccacaaggccaccgucuacaccggcagcgcccccuucaccccgaagcugggguccgugcaguucagcacggacaccgagaacgacuucgagacccaccagaacaccaaguucacgcccgugggcgucauccaggacggguccaccacccaccgcaacgagccccagcagugggugcuccccagcuacuccggccggaacgugccgaacguccaccuggcccccgccguggcgcccaccuuccccggggagcagcuccucuucuuccgcagcacgaugccgggcugcuccggcuaccccaacauggaccuggacugccugcucccccaggagugggugcagcacuucuaccaggaggccgcccccgcccagagcgacgucgcgcugcugcgguucgugaacccggacaccgggcgcguccucuucgagugcaagcugcacaaguccggcuacgugaccguggcccacaccgggcagcacgaccuggugaucccgcccaacggcuacuuccgguucgacagcugggucaaccaguucuacacccucgcccccauggggaacggcacgggccgccggcgcgcccuguga

SEQ ID NO: 10097 - RNA, 1623 nt, Artificial Sequence
  derived and/or modified sequence opt1 from VP1__Norovirus__BAS30185
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggaugcugacccagaccaccaagggcgacgggagcacgcggggccacaaggccaccgucuacaccggcagcgcccccuucaccccgaagcugggguccgugcaguucagcacggacaccgagaacgacuucgagacccaccagaacaccaaguucacgcccgugggcgucauccaggacggguccaccacccaccgcaacgagccccagcagugggugcuccccagcuacuccggccggaacgugccgaacguccaccuggcccccgccguggcgcccaccuuccccggggagcagcuccucuucuuccgcagcacgaugccgggcugcuccggcuaccccaacauggaccuggacugccugcucccccaggagugggugcagcacuucuaccaggaggccgcccccgcccagagcgacgucgcgcugcugcgguucgugaacccggacaccgggcgcguccucuucgagugcaagcugcacaaguccggcuacgugaccguggcccacaccgggcagcacgaccuggugaucccgcccaacggcuacuuccgguucgacagcugggucaaccaguucuacacccucgcccccauggggaacggcacgggccgccggcgcgcccuguga

SEQ ID NO: 10098 - RNA, 1623 nt, Artificial Sequence
  derived and/or modified sequence opt1 from VP1__Norovirus__BAS30188
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggaugcugacccagaccaccaagggcgacgggagcacgcggggccacaaggccaccgucuacaccggcagcgcccccuucaccccgaagcugggguccgugcaguucagcacggacaccgagaacgacuucgagacccaccagaacaccaaguucacgcccgugggcgucauccacgacggguccaccacccaccgcaacgagccccagcagugggugcuccccagcuacuccggccggaacgugccgaacguccaccuggcccccgccguggcgcccaccuuccccggggagcagcuccucuucuuccgcagcacgaugccgggcugcuccggcuaccccaacauggaccuggacugccugcucccccaggagugggugcagcacuucuaccaggaggccgcccccgcccagagcgacgucgcgcugcugcgguucgugaacccggacaccgggcgcguccucuucgagugcaagcugcacaaguccggcuacgugaccguggcccacaccgggcagcacgaccuggugaucccgcccaacggcuacuuccgguucgacagcugggucaaccaguucuacacccucgcccccauggggaacggcacgggccgccggcgcgcccuguga

SEQ ID NO: 10099 - RNA, 1623 nt, Artificial Sequence; identical to SEQ ID NO: 10051
  derived and/or modified sequence opt1 from VP1__Norovirus__BAS30191

SEQ ID NO: 10100 - RNA, 1623 nt, Artificial Sequence; identical to SEQ ID NO: 10051
  derived and/or modified sequence opt1 from VP1__Norovirus__BAS30194

SEQ ID NO: 10101 - RNA, 1623 nt, Artificial Sequence; identical to SEQ ID NO: 10051
  derived and/or modified sequence opt1 from VP1__Norovirus__BAS30197

SEQ ID NO: 10102 - RNA, 1623 nt, Artificial Sequence; identical to SEQ ID NO: 10051
  derived and/or modified sequence opt1 from VP1__Norovirus__BAS30200

SEQ ID NO: 10103 - RNA, 1623 nt, Artificial Sequence; identical to SEQ ID NO: 10051
  derived and/or modified sequence opt1 from VP1__Norovirus__BAS30203

SEQ ID NO: 10104 - RNA, 1623 nt, Artificial Sequence; identical to SEQ ID NO: 10051
  derived and/or modified sequence opt1 from VP1__Norovirus__BAS30206

SEQ ID NO: 10105 - RNA, 1623 nt, Artificial Sequence
  derived and/or modified sequence opt1 from VP1__Norovirus__BAS30209
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggaggugccggcgccccucgggacgcccgacuucgucggcaagauccagggggugcugacccagaccaccaagggcgacggguccacgcggggccacaaggccaccguguacaccggcagcgcccccuucaccccgaagcuggggagcguccaguucuccacggacaccgagaacgacuucgagacccaccagaacaccaaguucacgcccgugggcgugauccaggacgggagcaccacccaccgcaacgagccccagcaguggguccuccccuccuacagcggccgggacgugccgaacgugcaccuggcccccgccgucgcgcccaccuuccccggggagcagcuccucuucuuccgcuccacgaugccgggcugcagcggcuaccccaacauggaccuggacugccugcucccccaggagugggugcagcacuucuaccaggaggccgcccccgcccaguccgacguggcgcugcugcgguucgucaacccggacaccgggcgcguccucuucgagugcaagcugcacaagagcggcuacgugaccguggcccacaccgggcagcacgaccuggugaucccgcccaacggcuacuuccgguucgacuccugggugaaccaguucuacacccucgcccccauggggaacggcacgggccgccggcgcgcccuguga

SEQ ID NO: 10106 - RNA, 1623 nt, Artificial Sequence
  derived and/or modified sequence opt1 from VP1__Norovirus__BAS30212
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcgggacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 10107 - RNA, 1623 nt, Artificial Sequence
  derived and/or modified sequence opt1 from VP1__Norovirus__BAS30215
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggagcaccacccaccgcaacgagccccagcagugggugcuccccuccuacagcggccggaacgugccgaacguccaccuggcccccgccguggcgcccaccuuccccggggagcagcuccucuucuuccgcuccacgaugccgggcugcagcggcuaccccaacauggaccuggacugccugcucccccaggagugggugcagcacuucuaccaggaggccgcccccgcccaguccgacgucgcgcugcugcgguucgugaacccggacaccgggcgcguccucuucgagugcaagcugcacaagagcggcuacgugaccguggcccacaccgggcagcacgaccuggugaucccgcccaacggcuacuuccgguucgacuccugggucaaccaguucuacacccucgcccccauggggaacggcacgggccgccggcgcgcccuguga

SEQ ID NO: 10108 - RNA, 1623 nt, Artificial Sequence; identical to SEQ ID NO: 10107
  derived and/or modified sequence opt1 from VP1__Norovirus__BAS30218

SEQ ID NO: 10109 - RNA, 1623 nt, Artificial Sequence
  derived and/or modified sequence opt1 from VP1__Norovirus__BAS30221
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagguccagggggugcugacccagaccaccaagggcgacgggagcacgcggggccacaaggccaccguguacaccggcagcgcccccuucaccccgaagcugggguccguccaguucagcacggacaccgagaacgacuucgagacccaccagaacaccaaguucacgcccgugggcgugauccaggacggguccaccacccaccgcaacgagccccagcaguggguccuccccagcuacuccggccggaacgugccgaacgugcaccuggcccccgccgucgcgcccaccuuccccggggagcagcuccucuucuuccgcagcacgaugccgggcugcuccggcuaccccaacauggaccuggacugccugcucccccaggagugggugcagcacuucuaccaggaggccgcccccgcccagagcgacguggcgcugcugcgguucgucaacccggacaccgggcgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgccggcgcgcccuguga

SEQ ID NO: 10110 - RNA, 1623 nt, Artificial Sequence
  derived and/or modified sequence opt1 from VP1__Norovirus__BAS30224
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccgugcugaccguggaggagaugaccaacucccgguuccccaucccccuggagaagcuguucaccggccccagcuccgccuucgucgugcagccgcagaacgggcgcugcacgaccgacggcguccugcuggggaccacccagcucagccccgugaacaucugcacguuccggggcgacgugacccacaucgccggcucccgcaacuacaccaugaaccuggccagccugaacuggaacaacuacgaccccaccgaggagaucccggcgccccucgggacgcccgacuucgucggcaagauccaggggaugcugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggagcaccacccaccgcaacgagccccagcagugggugcuccccuccuacagcggccggaacgucccgaacgugcaccuggcccccgccguggcgcccaccuuccccggggagcagcuccucuucuuccgcuccacgaugccgggcugcagcggcuaccccaacauggaccuggacugccugcucccccaggaguggguccagcacuucuaccaggaggccgcccccgcccaguccgacguggcgcugcugcgguucgugaacccggacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucgcccccauggggaacggcacgggccgccggcgcgcccuguga

SEQ ID NO: 10111 - RNA, 1623 nt, Artificial Sequence
  derived and/or modified sequence opt1 from VP1__Norovirus__BAS30227
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcgccaagcccuucaccguccccauccugacgguggaggagaugaccaacagccgguuccccaucccccuggagaagcuguucaccggccccuccagcgccuucgugguccagccgcagaacgggcgcugcaccacggacggcgugcuccuggggaccacccagcucucccccgucaacaucugcaccuuccggggcgacgugacgcacaucgccggcagccgcaacuacaccaugaaccuggcgucccccaacuggaacaacuacgacccgaccgaggagauccccgcgccccuggggacccccgacuucgugggcaagauccaggggaugcucacgcagaccaccaagggcgacgggagcacccggggccacaaggccacggucuacaccggcagcgccccguucacccccaagcugggguccgugcaguucagcaccgacacggagaacgacuucgagacccaccagaacaccaaguucacccccgugggcgucauccaggacggguccacgacccaccgcaacgagccccagcagugggugcugccgagcuacuccggccggaacgugcccaacguccaccucgcccccgccguggcccccaccuucccgggggagcagcugcuguucuuccgcagcaccaugcccggcugcuccggcuaccccaacauggaccucgacugccugcugccccaggagugggugcagcacuucuaccaggaggccgccccggcgcagagcgacgucgcccuccugcgguucgugaaccccgacacggggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcaccggccgccggcgcgcccucuga

SEQ ID NO: 10112 - RNA, 1623 nt, Artificial Sequence
  derived and/or modified sequence opt1 from VP1__Norovirus__BAS30230
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacagcuacgccggcggguucgaggugcaggucauccucgccggcaacgccuucaccgccgggaagaucaucuucgccgccgugccgcccaacuucccgacggagggccugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggggaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacggccgcugcacgaccgacggggugcugcugggcaccacccagcucucccccgucaacaucugcacguuccgcggggacgugacccacaucgccagcucccggaacuacaccaugaaccuggccagccugaacuggaacaacuacgaccccaccgaggagaucccggcgccccucggcacgcccgacuucgugggcaagauccaggggaugcugacccagaccaccaagggcgacgggagcacgcggggccacaaggccaccgucuacaccggguccgcccccuucaccccgaagcugggcagcgugcaguucuccacggacaccgagaacgacuucgagacccaccagaacaccaaguucacgcccgugggcgucauccaggacgggagcaccacccaccgcaacgagccccagcagugggugcuccccuccuacagcggccggaacgugccgaacguccaccuggcccccgccguggcgcccgccuuccccggggagcagcuccucuucuuccgcuccaccaugccgggcugcagcggguaccccaacauggaccuggacugccugcucccccaggagugggugcagcacuucuaccaggaggccgcccccgcgcaguccgacgucgcccugcugcgguucgugaacccggacacgggccgcguccucuucgagugcaagcugcacaagagcggcuacgugaccguggcccacaccgggcagcacgaccuggugaucccgcccaacggcuacuuccgguucgacuccugggucaaccaguucuacacccucgcccccauggggaacggcaccgggcgccggcgcgcccuguga

SEQ ID NO: 10113 - RNA, 1623 nt, Artificial Sequence; identical to SEQ ID NO: 9441
  derived and/or modified sequence opt1 from VP1__Norovirus__BAS30233

SEQ ID NO: 10114 - RNA, 1623 nt, Artificial Sequence; identical to SEQ ID NO: 10107
  derived and/or modified sequence opt1 from VP1__Norovirus__BAS30236

SEQ ID NO: 10115 - RNA, 1623 nt, Artificial Sequence; identical to SEQ ID NO: 10107
  derived and/or modified sequence opt1 from VP1__Norovirus__BAS30239

SEQ ID NO: 10116 - RNA, 1623 nt, Artificial Sequence
  derived and/or modified sequence opt1 from VP1__Norovirus__BAS30242
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggaggugccggcgccccucgggacgcccgacuucgucggcaagauccagggggugcugacccagaccaccaagggcgacggguccacgcggggccacaaggccaccguguacaccggcagcgcccccuucaccccgaagcuggggagcguccaguucuccacggacaccgagaacgacuucgagacccaccagaacaccaaguucacgcccgugggcgugauccaggacgggggcaccacccaccgcaacgagccccagcaguggguccuccccagcuacuccgggcgggacgugccgaacgugcaccuggcccccgccgucgcgcccaccuuccccggcgagcagcuccucuucuuccgcagcacgaugccgggcugcuccggguaccccaacauggaccuggacugccugcucccccaggagugggugcagcacuucuaccaggaggccgcccccgcccagagcgacguggcgcugcugcgguucgucaacccggacaccggccgcguccucuucgagugcaagcugcacaaguccggguacgugaccguggcccacaccggccagcacgaccuggugaucccgcccaacggguacuuccgguucgacagcugggugaaccaguucuacacccucgcccccaugggcaacggcacggggcgccggcgcgcccuguga

SEQ ID NO: 10117 - RNA, 1620 nt, Artificial Sequence
  derived and/or modified sequence opt1 from VP1__Norovirus__BAS30245
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccaucccgcccaacuucccgacggaggggcugagccccucccaggugaccauguucccccacaucguggucgacgugcggcagcuggagcccgugcucaucccgcugcccgacguccgcaacaacuucuaccacuacaaccagaccaaggagagcaccaucaagcugguggccaugcucuacacgccccugcgggcgaacaacgccggcgacgacguguucaccgucuccugccgcgugcugacccggcccagcccggacuucgacuucaucuuccucgugccgcccuccgucgagagccgcaccaagcccuucacggugcccauccugaccguggaggagaugaccaacucccgguuccccaucccccuggagcgccucuucaccggccccagcuccgccuucgucgugcagccgcagaacgggcggugcacgaccgacggcguccugcuggggaccacccagcucagccccgugaacaucugcacguuccgcggcgacgugacccgggucuccaccacccacguguacgagaugaaccuggccagccagaacuggaacaacuacgaccccacggaggaggugccggcgccccugggcacccccgacuucgucgggaagauccagggcgugcucacccagaccacgcgcaccgacggguccacccgggcccacaaggccaccgugagcacgggcgccgccgacuucacccccaagcuggggagcauccgcuucgagaccaccacgaaccgggaccuggagacccaccagaacaccaaguucaccccggucggcgugauccaggacggcgacaaccaccagaacgagccccagcaguggcgccuccccggguacgccggccgggacgcgcacaacgugcaccuggcccccgccgucgccccgacguuccccggggagcagcuccucuucuuccgcuccaccaugcccggcugcagcggguaccccaacaugaaccuggacugccugcucccgcaggagugggugcagcacuucuaccaggaggcggcccccgcccaguccgacguggcccugcugcgguucgucaaccccgacaccggccgcgugcuguucgagugcaagcugcacaagagcggcuaccugaccguggcccacaccgggcccuacgaccucgucaucccgcccaacggcuacuuccgcuucgacuccugggugaaccaguucuacacgcuggcgcccauggggaacggcaccgggcggcgccgggcccuguga

SEQ ID NO: 10118 - RNA, 1623 nt, Artificial Sequence
  derived and/or modified sequence opt1 from VP1__Norovirus__BAS30248
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucaccggcagccgcaacuacaccaugaaccuggccacgcagaacuggaacuccuacgacccgaccgaggagauccccgcgccccuggggacccccgacuucgugggcaagauccaggggguccucacccagacgacccgggccgacggcagcacccgcgggcacaaggccaucguguacaccggcagcgccgacuucgccccgaagcugggccgggugcaguucgccacggacaccgacaacgacuucggggccaaccagaacaccaaguucacccccgucggcgugauccaggacggggacacggcgcaccgcaacgagccccagcagugggugcugcccuccuacagcggccggaacucccacaacguccaccucgccccggccguggcccccaccuuccccggggagcagcugcuguucuuccgcagcaccaugcccggcugcuccggcuacccgaacauggaccucgacugccugcugccccaggagugggugcaguacuucuaccaggaggcggcccccgcccagagcgacgucgcccuccugcgguucgugaaccccgacaccgggcgcgugcuguucgagugcaagcuccacaaguccggcuacgucacgguggcccacaccgggcagcacgaccuggugaucccgcccaacggcuacuuccgguucgacagcugggucaaccaguucuacacccuggcgcccauggggaacggcaccggccgccgccgggcccucuga

SEQ ID NO: 10119 - RNA, 1623 nt, Artificial Sequence; identical to SEQ ID NO: 9382
  derived and/or modified sequence opt1 from VP1__Norovirus__BAS30251

SEQ ID NO: 10120 - RNA, 1626 nt, Artificial Sequence
  derived and/or modified sequence opt1 from VP1__Norovirus__BAS30254
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagcaaggucucccccaucccccugaagaagcuguucaccggcccgagcuccgccuucgugguccagccccagaacgggcggugcacgaccgacggcgugcuccuggggaccacccagcucagccccgugaacaucugcacguuccgcggcgacgucacccacaucccgggcucccggaacuacaccaugaaccuggccagccagaacuggaacagcuacgaccccaccgaggagauccccgcgccccuggggacgccggacuucgugggcaagauccagggggugcucacccagaccacccgcacgaacggcuccacccgggggcacaaggccaccgucuacaccggcagcgccgacuucucccccaagcugggccgcgugcaguucgccacggacaccgacaacgacuucgagaccaaccagaacaccaaguucacgcccgugggggucauccaggacggcagcaccacgccccggaacgagccgcagcagugggugcugcccuccuacagcgggcgcaacauccacaacgugcaccucgcccccgccgucgcccccaccuucccgggcgagcagcugcuguucuuccgguccaccaugcccgggugcagcggcuaccccaacauggaccucgacugccugcugccccaggagugggugcaguacuucuaccaggaggcggccccggcccaguccgacguggcccuccugcgcuucgucaaccccgacaccggccgggugcuguucgagugcaagcuccacaagagcggguacgugaccgucgcgcacaccggccagcacgaccuggugaucccgcccaacggguacuuccgcuucgacuccugggugaaccaguucuacacccuggcccccaugggcaacgggacgggccggcgccgcgcccucuga

SEQ ID NO: 10121 - RNA, 1623 nt, Artificial Sequence; identical to SEQ ID NO: 9405
  derived and/or modified sequence opt1 from VP1__Norovirus__BAS30257

SEQ ID NO: 10122 - RNA, 1623 nt, Artificial Sequence; identical to SEQ ID NO: 8882
  derived and/or modified sequence opt1 from VP1__Norovirus__BAS30260

SEQ ID NO: 10123 - RNA, 1623 nt, Artificial Sequence
  derived and/or modified sequence opt1 from VP1__Norovirus__BAS30263
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggaguccgagacgaagcccuucuucuuccccguccugaccguggaggagaugaccaacagccgcuuccccaucccccuggagaagcuguucaccggccccuccagcgccuucgugguccagccgcagaacgggcggugcacgaccgacggcgugcuccuggggaccacccagcucucccccgucaacaucugcacguuccgcggcgacgugacccacauccccggcagccggaacuacaccaugaaccuggccucccagaacuggaacagcuacgacccgaccgaggagauccccgcgccccuggggacgcccgacuucgugggcaagauccaggggguccucacccagaccacccgcacgaacggcagcacccgggggcacaaggccaccguguacaccggcuccgccgacuucagcccgaagcugggccgcgugcaguucgccacggacaccgacaacgacuucgagaccaaccagaacaccaaguucacgcccgucggggugauccaggacggcuccaccacgccccggaacgagccccagcagugggugcugccgagcuacuccgggcgcaacauccacaacguccaccucgcccccgccguggcccccaccuuccccggcgagcagcugcuguucuuccggagcaccaugccggggugcuccggcuaccccaacauggaccucgacugccugcugccccaggagugggugcaguacuucuaccaggaggcggcccccgcccagagcgacgucgcccuccugcgcuucgugaacccggacaccggccgggugcuguucgagugcaagcuccacaaguccggguacgucaccguggcgcacaccggccagcacgaccuggugaucccgcccaacggguacuuccgcuucgacagcugggucaaccaguucuacacccuggcccccaugggcaacgggacgggccggcgccgcgcccucuga

SEQ ID NO: 10124 - RNA, 1623 nt, Artificial Sequence; identical to SEQ ID NO: 9405
  derived and/or modified sequence opt1 from VP1__Norovirus__BAS30266

SEQ ID NO: 10125 - RNA, 1623 nt, Artificial Sequence; identical to SEQ ID NO: 9405
  derived and/or modified sequence opt1 from VP1__Norovirus__BAS30269

SEQ ID NO: 10126 - RNA, 1623 nt, Artificial Sequence; identical to SEQ ID NO: 9405
  derived and/or modified sequence opt1 from VP1__Norovirus__BAS30272

SEQ ID NO: 10127 - RNA, 1623 nt, Artificial Sequence
  derived and/or modified sequence opt1 from VP1__Norovirus__BAS30275
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccuguucccccuggcccgcaaggugaagggcuacgccgggggcuucgagguccaggugauccucgccgggaaggccuuccccgcgggcaagaucaucuucgccgccuccccgcccaacuuccccacggaggggcugagccccucccaggugaccauguucccgcacaucaucgucgacgugcggcagcuggagcccgugcucaucccccugcccgacguccgcaacaacuucuaccacuacaaccagagcaacgacuccaccaucaagcugaucgccaugcucuacaccccgcugcgggccaacaacgcgggcgaggacguguucacggugagcugccgcguccugacccggcccucccccgacuucgacuucaucuuccucgugcccccgaccguggagagccgcaccaagcccuucuccguccccauccugacgguggaggagaugaccaacagccgguuccccaucccgcuggagaagcuguucaccggccccuccagcaccuucgugguccagccccagaacgggcgcugcacgaccgacggcgugcuccuggggaccacccagcucuccccggucaacaucugcacguuccggggcgacgugacccacaucgccggcagccgcaacuacaccaugaaccuggccucccagaacuggaacagcuacgaccccaccgaggagauccccgcgccccuggggacgccggacuucgugggcaagauccaggggguccucacccagaccacccggcgcgacggcagcacgcgggggcacaaggccaccguguacaccggcuccgccgacuucagccccaagcugggccgcgugcaguucgccaccgacacggacaacgacuucgacacccaccagaacaccaaguucacccccgucggggugauccaggacggcgggacggcccaccggaacgagccccagcagugggugcugccguccuacagcggccgcaacacccacaacguccaccucgcccccgccguggcgcccaccuuccccggggagcagcugcuguucuuccgguccaccaugccgggcugcagcggcuaccccaacauggaccucgacugccugcugccccaggagugggugcaguacuucuaccaggaggccgcccccgcccaguccgacgucgcgcuccugcgcuucgugaacccggacacggggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcaccggccgccggcgcgcccucuga

SEQ ID NO: 10128 - RNA, 1623 nt, Artificial Sequence; identical to SEQ ID NO: 9405
  derived and/or modified sequence opt1 from VP1__Norovirus__BAS30278

SEQ ID NO: 10129 - RNA, 1623 nt, Artificial Sequence; identical to SEQ ID NO: 8878
  derived and/or modified sequence opt1 from VP1__Norovirus__BAS30284

SEQ ID NO: 10130 - RNA, 1623 nt, Artificial Sequence
  derived and/or modified sequence opt1 from VP1__Norovirus__BAS30287
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcuggaucaaccaguucuacacccuggcccccaugggcaacgggacgggccgccgccgggcccucuga

SEQ ID NO: 10131 - RNA, 1623 nt, Artificial Sequence
  derived and/or modified sequence opt1 from VP1__Norovirus__BAS30290
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgaccccaccgaggagaucccggcgccccuggggacgcccgacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgccggugggggugauccaggacggcuccaccacgccccgcaacgagccccagcaguggguccugcccagcuacuccgggcggagcauccacaacgugcaccucgccccggccguggcccccaccuuccccggcgagcagcugcuguucuuccgcuccaccaugcccgggugcagcggcuacccgaacauggaccucgacugccugcugccccaggaguggguccaguacuucuaccaggaggcggcccccgcccaguccgacguggcccuccugcgguucgugaaccccgacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgggcccucuga

SEQ ID NO: 10132 - RNA, 1623 nt, Artificial Sequence
  derived and/or modified sequence opt1 from VP1__Norovirus__BAS30293
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcacguucgugguccagccccagaacgggcgcugcaccaccgacggcgugcuccuggggaccacgcagcucucccccgucaacaucugcaccuuccggggcgacgugacccacaucgccggcagccgcaacuacaccaugaaccuggccucccagaacuggaacagcuacgacccgacggaggagauccccgcgccccuggggacccccgacuucgugggcaagauccaggggguccucacccagaccacgcggaccgacggcagcacccgcgggcacaaggccaccguguacacgggcuccgccgacuucagcccgaagcugggccgggugcaguucgccaccgacaccgacaacgacuucgacgccaaccagaacaccaaguucacgcccgucggggugauccaggacggcgggaccgcccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgccaccgucgcccacaccgggcagcacgaccuggugaucccgcccaacggcuacuuccgguucgacuccugggugaaccaguucuacacccuggcccccauggggaacggcacgggccgccgccgggcgcucuga

SEQ ID NO: 10133 - RNA, 1623 nt, Artificial Sequence
  derived and/or modified sequence opt1 from VP1__Norovirus__BAS30296
augaagauggccagcaaccacgugaaccccuccgacggcagcaccgccaaccuggucccggaggugaacaacgaggugauggcgcucgagcccgucgugggggccgccaucgccgcccccguggcgggccagcagaacgucaucgaccccuggauccgcaacaacuucgugcaggcccccgggggcgaguucaccgugagcccccggaacgcccccggggagauccugugguccgcgccccugggcccggaccucaaccccuaccugucccaccuggcccgcauguacaacggcuacgccgggggcuucgagguccaggugauccucgccgggaacgccuucacggccggcaagaucaucuucgcggccgugccgcccaacuucccgaccgaggggcugagccccucccaggucaccauguucccccacaucaucguggacgugcggcagcuggagcccguccucaucccgcugcccgacgugcgcaacaacuucuaccacuacaaccagagcaacgaccccaccaucaagcugaucgccaugcucuacacgccccugcgggccaacaacgccggcgacgacguguucaccgucuccugccgcgugcugacccggccgagccccgacuucgacuucaucuuccucgugccgcccaccgucgagucccgcacgaagcccuucagcgugcccgugcugaccgucgaggagaugaccaacucccgguuccccaucccccuggagaagcuguucaccggcccgagcuccgcguucgugguccagccccagaacgggcgcugcacgaccgacggcgugcuccuggggaccacccagcucagccccgugaacaucugcacguuccggggcgacgucacccacaucccgggcucccgcaacuacaccaugaaccuggccagccagaacuggaacuccuacgaccccaccgaggagauccccgcgccccuggggacgccggacuucgugggcaagauccagggggugcucacccagaccacccggacgaacggcagcacccgcgggcacaaggccaccgucuacaccggcagcgccgacuucucccccaagcugggccgggugcaguucgccacggacaccgacaacgacuucgagaccaaccagaacaccaaguucacgcccgugggggucauccaggacggcagcaccacgccccgcaacgagccgcagcagugggugcugcccuccuacagcgggcggaacauccacaacgugcaccucgcccccgccgucgcccccaccuucccgggcgagcagcugcuguucuuccgcuccaucaugcccgggugcagcggcuaccccaacauggaccucgacugccugcugccccaggagugggugcaguacuucuaccaggaggccgcgccggcccaguccgacguggcccuccugcgguucgucaaccccgacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcgcccaugggcaacgggaccggccgccgccgggcccucuga

SEQ ID NO: 10134 - RNA, 1623 nt, Artificial Sequence; identical to SEQ ID NO: 9383
  derived and/or modified sequence opt1 from VP1__Norovirus__BAS30299

SEQ ID NO: 10135 - RNA, 1623 nt, Artificial Sequence
  derived and/or modified sequence opt1 from VP1__Norovirus__BAS30302
augaagauggccagcuccgacgccaaccccuucgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccugagccgcauguacaacggcuacgccgggggcuucgaggugcaggucauccucgccgggaacgccuucacggccggcaagaucaucuucgcggccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgccggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgcguucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggccgcgccggcccagagcgacguggcccuccugcgguucgugaaccccgacaccggccgcguccuguucgagugcaagcuccacaaguccggguacgugaccguggcccacaccggccagcacgaccuggucaucccgcccaacggguacuuccgguucgacagcugggugaaccaguucuacacccuggcgcccaugggcaacgggacgggccgccgccgggcccucuga

SEQ ID NO: 10136 - RNA, 1623 nt, Artificial Sequence
  derived and/or modified sequence opt1 from VP1__Norovirus__BAS30305
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccggcacgcugggccccgaccucaacccguaccugagccaccuggcgcgcauguacaacggguacgccggcggguucgaggugcaggucauccucgccggcaacgccuucaccgccgggaagaucaucuucgcggccgugccgcccaacuuccccaccgagggccuguccccgagccaggugaccauguucccccacaucaucgucgacgugcggcagcuggagcccgugcucaucccccugccggacguccgcaacaacuucuaccacuacaaccaguccaacgaccccacgaucaagcugaucgccaugcucuacacgccccugcgggccaacaacgccggcgacgacguguucaccgugagcugccgcguccugacccggcccuccccggacuucgacuucaucuuccucgugccgcccaccguggagagccgcaccaagcccuucuccguccccgugcugaccguggaggagaugaccaacagccgguuccccaucccccuggagaagcuguucacggggcccuccagcgcguucgucgugcagccgcagaacggccgcugcaccaccgacgggguccuccugggcaccacgcagcucucccccgugaacaucugcaccuuccggggcgacgugacccacauccccgggagccgcaacuacaccaugaaccuggccucccagaacuggaacagcuacgacccgacggaggagauccccgcgccccugggcacccccgacuucgucgggaagauccagggcgugcucacccagaccacgcggaccaacgggagcacccgcggccacaaggccaccguguacacgggcuccgccgacuucagcccgaagcuggggcggguccaguucgccaccgacaccgacaacgacuucgagaccaaccagaacacgaaguucacccccgugggcgugauccaggacggguccaccacgccccgcaacgagccccagcaguggguccugccgagcuacuccggccggaacauccacaacgugcaccucgcccccgccguggcccccaccuuccccggggagcagcugcuguucuuccgcagcaccaugccgggcugcuccggcuaccccaacauggaccucgacugccugcugccccaggaguggguccaguacuucuaccaggaggccgcgcccgcccagagcgacguggcccuccugcgguucgugaacccggacaccgggcgcguccuguucgagugcaagcuccacaaguccggcuacgugaccguggcccacaccgggcagcacgaccuggucaucccgcccaacggcuacuuccgguucgacagcugggugaaccaguucuacacgcuggcgcccauggggaacggcaccggccgccgccgggcccucuga

SEQ ID NO: 10137 - RNA, 1626 nt, Artificial Sequence
  derived and/or modified sequence opt1 from VP1__Norovirus__BAS30308
augaagauggccagcaacgacgugaaccccuccgacggcagcaccgccaaccuggucccggaggugaacaacgaggugauggcgcucgagcccgucgugggggccgccaucgccgcccccguggcgggccagcagaacgucaucgaccccuggauccgcaacaacuucgugcaggcccccgggggcgaguucaccgugagcccccggaacgcccccggggagauccugugguccgcgccccugggcccggaccucaaccccuaccugucccaccuggcccgcauguacaacggcuacgccgggggcuucgagguccaggugauccucgccgggaacgccuucacggccgugguccggaucaucuucagcgcggugccgcccaacuucccgaccgagggccugucccccagccaggugaccauguucccccacaucaucgucgacgugcgccagcuggagcccgugcucaucccgcugcccgacguccggaacaacuucuaccacuacaaccaguccaacgacagcaccaucaagcugaucgccaugcucuacacgccccugcgcgccaacaacgccggggacgacguguucaccguguccugccggguccugacccgccccagcccggacuucgacuucaucuuccucgugccgcccaccguggagucccggacgaagcccuucagcguccccgugcugaccgucgaggagaugaccaacucccgcuuccccaucccccuggagaagcuguucaccggccccagcuccgccuucguggugcagccgcagaacggccggugcacgaccgacgggguccuccugggcaccacccagcucagccccgugaacaucugcacguuccgcggggacgugacccacaucuccggcagccggaacuacaccaugaaccuggcgagccagaacuggaacuccuacgaccccaccgaggagaucccggcgccccugggcacgcccgacuucgucgggaagauccagggcgugcucacccagaccacccgcacgaacgggagcacccggggccacaaggccaccguguacaccggguccgccgacuucagccccaagcugggccgcguccaguucgccacggacaccgacaacgacuucgagaccaaccagaacaccaaguucacgccggugggcgugauccaggacggguccaccacgccccggaacgagccccagcaguggguccugcccagcuacuccggccgcaacauccacaacgugcaccucgccccggccguggcccccaccuuccccggggagcagcugcuguucuuccggagcaccaugcccggcugcuccggguacccgaacauggaccucgacugccugcugccccaggaguggguccaguacuucuaccaggaggccgcccccgcgcagagcgacguggcccuccugcgcuucgugaaccccgacaccggccggguccuguucgagugcaagcuccacaaguccggcuacgugaccguggcccacaccgggcagcacgaccuggucaucccgcccaacggcuacuuccgcuucgacagcugggugaaccaguucuacacccuggcccccauggggaacggcacggggcgccggcgcgcgcucuga

SEQ ID NO: 10138 - RNA, 1623 nt, Artificial Sequence; identical to SEQ ID NO: 8842
  derived and/or modified sequence opt1 from VP1__Norovirus__BAS30311

SEQ ID NO: 10139 - RNA, 1623 nt, Artificial Sequence
  derived and/or modified sequence opt1 from VP1__Norovirus__BAS30314
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaacaaccagaacaccaaguucacccccgugggggugauccaggacggcuccacgacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggaccggccgccgccgggcccucuga

SEQ ID NO: 10140 - RNA, 1623 nt, Artificial Sequence
  derived and/or modified sequence opt1 from VP1__Norovirus__BAS30317
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcacguucgugguccagccccagaacgggcgcugcaccaccgacggcgugcuccuggggaccacgcagcucucccccgucaacaucugcaccuuccggggcgacgugacccacaucgccggcagccgcaacuacaccaugaaccuggccucccagaacuggaacagcuacgacccgacggaggagauccccgcgccccuggggacccccgacuucgugggcaagauccaggggguccucacccagaccacgcggaccgacggcagcacccgcgggcacaaggccaccguguacacgggcuccgccgacuucagcccgaagcugggccgggugcaguucgccaccgacaccgacaacgacuucgacgccaaccagaacaccaaguucacgcccgucggggugauccaggacggcgggaccgcccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgggcccucuga

SEQ ID NO: 10141 - RNA, 1623 nt, Artificial Sequence; identical to SEQ ID NO: 10140
  derived and/or modified sequence opt1 from VP1__Norovirus__BAS30320

SEQ ID NO: 10142 - RNA, 1623 nt, Artificial Sequence
  derived and/or modified sequence opt1 from VP1__Norovirus__BAS30323
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcgggaccacgccccgcaacgagccccagcaguggguccugccgagcuacuccggccggaacauccacaacgugcaccucgcccccgccguggcccccaccuuccccggggagcagcugcuguucuuccgcagcaccaugccgggcugcuccggcuaccccaacauggaccucgacugccugcugccccaggaguggguccaguacuucuaccaggaggcggcccccgcccagagcgacguggcccuccugcgguucgugaacccggacaccgggcgcguccuguucgagugcaagcuccacaaguccggcuacgugaccguggcgcacaccgggcagcacgaccuggucaucccgcccaacggcuacuuccgguucgacagcugggugaaccaguucuacacccuggcccccauggggaacggcacgggccgccgccgggcccucuga

SEQ ID NO: 10143 - RNA, 1623 nt, Artificial Sequence
  derived and/or modified sequence opt1 from VP1__Norovirus__BAS30326
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucuccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccacguucgugguccagccccagaacgggcgcugcaccaccgacggcgugcuccuggggaccacgcagcucagccccgucaacaucugcaccuuccggggcgacgugacccacaucaccggcucccacaacuacacgaugaaccuggcgagccagaacuggaacagcuacgacccgaccgaggagauccccgcgccccuggggacccccgacuucgugggcaagauccaggggguccucacccagacgacccgcaccgacggcuccacccgggggcacaaggccacgguguacaccggcagcgccgaguucuccccgaagcugggccgcgugcaguucgccaccgacaccaacaacgacuucgacgccaaccagaacacgaaguucacccccgucggggugauccaggacggcgggaccacccaccggaacgagccccagcagugggugcugcccagcuacuccggccgcaacacgcacaacguccaccucgccccggccguggcccccaccuuccccggggagcagcugcuguucuuccggagcaccaugcccggcugcuccggcuacccgaacauggaccucgacugccugcugccccaggagugggugcagcacuucuaccaggaggccgcgcccgcccagagcgacgucgcccuccugcgcuucgugaaccccgacaccgggcgggugcuguucgagugcaagcuccacaaguccggcuacgucaccguggcccacacggggcagcacgaccuggugaucccgcccaacggcuacuuccgcuucgacagcugggucaaccaguucuacacccuggcgcccauggggaacggcaccggccggcgccgcgcccucuga

SEQ ID NO: 10144 - RNA, 1623 nt, Artificial Sequence; identical to SEQ ID NO: 9405
  derived and/or modified sequence opt1 from VP1__Norovirus__BAS30329

SEQ ID NO: 10145 - RNA, 1623 nt, Artificial Sequence
  derived and/or modified sequence opt1 from VP1__Norovirus__BAS30332
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucuccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccacgccccuggagaagcuguucaccggcccgagcuccaccuucgugguccagccccagaacgggcgcugcaccaccgacggcgugcuccuggggacgacccagcucagccccgucaacaucugcaccuuccggggcgacgugacccacaucacgggcucccacaacuacaccaugaaccuggcgagccagaacuggaacagcuacgacccgaccgaggagauccccgcgccccuggggacccccgacuucgugggcaagauccaggggguccucacgcagaccacccgcaccgacggcuccacgcgggggcacaaggccaccguguacaccggcagcgccgaguucuccccgaagcugggccgcgugcaggucgccaccgacacgaacaacgacuucgacgccaaccagaacaccaaguucacccccgugggggugauccaggacggcgggaccacgcaccggaacgagccccagcaguggguccugcccagcuacuccggccgcaacgcccacaacgugcaccucgccccggccguggcccccaccuuccccggggagcagcugcuguucuuccggagcaccaugcccggcugcuccggcuacccgaacauggaccucgacugccugcugccccaggaguggguccagcacuucuaccaggaggcggcccccgcccagagcgacguggcccuccugcgcuucgugaaccccgacaccgggcggguccuguucgagugcaagcuccacaaguccggcuacgugaccguggcgcacacggggcagcacgaccuggucaucccgcccaacggcuacuuccgcuucgacagcugggugaaccaguucuacacccuggcccccauggggaacggcaccggccggcgccgcgcccucuga

SEQ ID NO: 10146 - RNA, 1623 nt, Artificial Sequence
  derived and/or modified sequence opt1 from VP1__Norovirus__BAS30335
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcagccacaacuacaccaugaaccuggccucccagaacuggaacagcuacgacccgaccgaggagauccccgcgccccuggggacgcccgacuucgugggcaagauccaggggguccucacccagaccacccgcacggacggcagcacccgggggcacaaggccaccguguacaccggcuccgccgaguucagcccgaagcugggccgcgugcaguucgccacggacaccaacaacgacuucgacgccaaccagaacaccaaguucacccccgucggggugauccaggacggcgggacgacccaccggaacgagccccagcagugggugcugcccuccuacagcggccgcaacacccacaacguccaccucgccccggcgguggcccccaccuuccccggggagcagcugcuguucuuccgguccacgaugcccggcugcagcggcuacccgaacauggaccucgacugccugcugccccaggagugggugcaguacuucuaccaggaggccgcccccgcgcaguccgacgucgcccuccugcgcuucgugaaccccgacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccggcgccgcgcccucuga

SEQ ID NO: 10147 - RNA, 1623 nt, Artificial Sequence; identical to SEQ ID NO: 9382
  derived and/or modified sequence opt1 from VP1__Norovirus__BAS30338

SEQ ID NO: 10148 - RNA, 1623 nt, Artificial Sequence; identical to SEQ ID NO: 8882
  derived and/or modified sequence opt1 from VP1__Norovirus__BAS30341

SEQ ID NO: 10149 - RNA, 1623 nt, Artificial Sequence
  derived and/or modified sequence opt1 from VP1__Norovirus__BAS30344
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaucaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgggcccucuga

SEQ ID NO: 10150 - RNA, 1623 nt, Artificial Sequence; identical to SEQ ID NO: 8882
  derived and/or modified sequence opt1 from VP1__Norovirus__BAS30347

SEQ ID NO: 10151 - RNA, 1623 nt, Artificial Sequence; identical to SEQ ID NO: 8882
  derived and/or modified sequence opt1 from VP1__Norovirus__BAS30350

SEQ ID NO: 10152 - RNA, 1623 nt, Artificial Sequence
  derived and/or modified sequence opt1 from VP1__Norovirus__BAS30353
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccagcugaacgaccccaccaucaagcucaucgccaugcuguacacgccccugcgggccaacaacgcgggcgacgacguguucaccguguccugccgcguccucacccggccgagccccgacuucgacuucaucuuccuggugccgcccaccguggagucccgcacgaagcccuucagcguccccgugcugaccguggaggagaugaccaacucccgguuccccaucccccucgagaagcuguucaccggcccgagcuccgccuucgucgugcagccccagaacgggcgcugcacgaccgacggcguccugcucgggaccacccagcugagccccgugaacaucugcacguuccggggcgacgugacccacaucccgggcucccgcaacuacaccaugaaccuggccagccagaacuggaacuccuacgaccccaccgaggagauccccgcgccccucgggacgccggacuucgucggcaagauccagggggugcugacccagaccacccggacgaacggcagcacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccuccccuccuacagcgggcggaacauccacaacgugcaccuggcccccgccguggcccccaccuucccgggcgagcagcuccuguucuuccgcuccaccaugcccgggugcagcggcuaccccaacauggaccuggacugccugcucccccaggaguggguccaguacuucuaccaggaggcggccccggcccaguccgacguggcccugcugcgguucgugaaccccgacaccggccgcguccucuucgagugcaagcugcacaagagcggguacgugaccguggcgcacaccggccagcacgaccuggucaucccgcccaacggguacuuccgguucgacuccugggugaaccaguucuacacccucgcccccaugggcaacgggacgggccgccgccgggcccuguga

SEQ ID NO: 10153 - RNA, 1623 nt, Artificial Sequence
  derived and/or modified sequence opt1 from VP1__Norovirus__BAS30356
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgagccccugggcccggaccucaaccccuaccugagccaccuggcgcgcauguacaacggcuacgccgggggcuucgaggugcaggucauccucgccgggaacgccuucacggccggcaagaucaucuucgcggccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgccggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgcguucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcgggaccacccaccgcaacgagccccagcaguggguccugcccagcuacuccggccggaacauccacaacgugcaccucgccccggccguggcccccaccuuccccggggagcagcugcuguucuuccgcagcacgaugcccggcugcuccggcuacccgaacauggaccucgacugccugcugccccaggaguggguccaguacuucuaccaggaggccgcgcccgcccagagcgacguggcccuccugcgguucgugaaccccgacaccgggcgcguccuguucgagugcaagcuccacaaguccggcuacgugaccguggcccacaccgggcagcacgaccuggucaucccgcccaacggcuacuuccgguucgacagcugggugaaccaguucuacacccuggcgcccauggggaacggcacgggccgccgccgggcccucuga

SEQ ID NO: 10154 - RNA, 1623 nt, Artificial Sequence; identical to SEQ ID NO: 9405
  derived and/or modified sequence opt1 from VP1__Norovirus__BAS30359

SEQ ID NO: 10155 - RNA, 1623 nt, Artificial Sequence; identical to SEQ ID NO: 8882
  derived and/or modified sequence opt1 from VP1__Norovirus__BAS30362

SEQ ID NO: 10156 - RNA, 1623 nt, Artificial Sequence; identical to SEQ ID NO: 8878
  derived and/or modified sequence opt1 from VP1__Norovirus__BAS30365

SEQ ID NO: 10157 - RNA, 1623 nt, Artificial Sequence; identical to SEQ ID NO: 8882
  derived and/or modified sequence opt1 from VP1__Norovirus__BAS30368

SEQ ID NO: 10158 - RNA, 1623 nt, Artificial Sequence; identical to SEQ ID NO: 8882
  derived and/or modified sequence opt1 from VP1__Norovirus__BAS30371

SEQ ID NO: 10159 - RNA, 1623 nt, Artificial Sequence
  derived and/or modified sequence opt1 from VP1__Norovirus__BAS30374
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucaccggcagccgcaacuacaccaugaaccuggccucccagaacuggaacagcuacgacccgacggaggagauccccgcgccccuggggacccccgacuucgucggcaagauccagggggugcucacccagaccacgcggaccaacggcagcacccgcgggcacaaggccaccguguacacgggcuccgccgacuucagcccgaagcugggccggguccaguucgccaccgacaccgacaacgacuucgaggccaaccagaacaccaaguucacgcccgugggggugauccaggacggcuccaccacgccccgcaacgagccccagcaguggguccugccgagcuacuccgggcggaacauccacaacgugcaccucgcccccgccguggcgcccaccuuccccggcgagcagcugcuguucuuccgcagcaccaugccggggugcuccggcuaccccaacauggaccucgacugccugcugccccaggaguggguccaguacuucuaccaggaggccgcccccgcccagagcgacguggcgcuccugcgguucgugaacccggacaccggccgcguccuguucgagugcaagcuccacaaguccggguacgugaccguggcccacaccggccagcacgaccuggucaucccgcccaacggguacuuccgguucgacagcugggugaaccaguucuacacccuggcccccaugggcaacgggacgggccgccgccgggcccucuga

SEQ ID NO: 10160 - RNA, 1623 nt, Artificial Sequence
  derived and/or modified sequence opt1 from VP1__Norovirus__BAU16297
augaagauggccagcaacgacgacaaccccuccgacggcagcgccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggccaacaacgcgggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggaacaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccgggacacccacaacguccaccucgccccggccguggcgcccaccuuccccggggagcagcugcuguucuuccgcagcacgaugcccggcugcuccggcuacccgaacauggaccucgacugccugcugccccaggagugggugcaguacuucuaccaggaggccgcccccgcccagagcgacgucgcgcuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaacaaguucuacacccuggcccccauggggaacggcacgggccgccgccgggccguguga

SEQ ID NO: 10161 - RNA, 1623 nt, Artificial Sequence
  derived and/or modified sequence opt1 from VP1__Norovirus__BAU16299
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcaucaacuucgugcaggcccccaacggggaguucacggucagcccccggaacucccccggcgagauccugcucaaccuggagcugggcccggaccucaaccccuaccuggcgcaccugagccgcguguacaacggguacgccggcgggguggagguccaggugcuccuggccggcaacgccuucaccgccgggaagauccuguucgcggccgugccgcccaacuuccccgucgaguuccucucccccgcccagaucaccaugcugccccaccugaucguggacgugcggacccucgagcccaucaugaucccgcugcccgacguccgcaacacguucuuccacuacagcaaccagcccaacucccggaugcgccugguggccaugcucuacacgccccugcggagcaacggcuccggcgacgacguguucaccgucagcugccgcgugcugacccggccgacccccgacuucgaguucaccuaccucgugccgcccuccgucgagagcaagaccaagcccuucucccugcccauccugacccucagcgagcugacgaacucccgcuuccccgugcccaucgacagccuguucaccgcccacgacaacguguggcagguccagugccagaacgggcggugcacccucgacggcgagcugcaggggaccacgcagcugcucccgaccggcaucugcgcguuccgcggccgggugaccgcccagaucaaccagcgcgaccgguggcacaugcagcugcagaaccugaacgggaccacguacgaccccaccgacgacgugcccgccccgcucggcacccccgacuucaagggggucguguucggcauggucucccagcgcaacguggggaacgacgcccccggcagcacccgggcccagcaggcguggguguccacguacagcccccaguucgucccgaagcugggcagcgugaaccugcgcaucuccgacaacgacgacuuccaguuccagcccaccaaguucacccccgugggggucaacgacgacgacgacggccaccccuuccggcagugggagcucccgaacuacagcggggagcugacccugaacaugaaccucgccccgcccguggcccccaacuuccccggcgagcagcugcuguucuuccgcuccuucgugcccugcagcgggggcuacaaccagggcaucaucgacugccucaucccccaggaguggauccagcacuucuaccaggaguccgcccccagccaguccgacgucgcccugauccgguacgugaacccggacacggggcgcacccuguucgaggcgaagcuccaccgcagcggcuacaucaccguggcccacuccggggacuacccccuggucgugcccgccaacggccacuuccgguucgacagcugggugaaccaguucuacucccuggcccccauggagaccgggaacggccgccggcgcgcgcaguga

SEQ ID NO: 10162 - RNA, 1635 nt, Artificial Sequence
  derived and/or modified sequence opt1 from VP1__Norovirus__BAU16301
augaugauggccagcaaggacgccgcgcccuccgccgacggcgccaccggggccggccagcuggugccggaggucaacaccgccgaccccauccccaucgaccccguggcggggagcuccacggcccucgccaccgccggccaggugaaccugaucgacccguggaucaucaacaacuucguccaggcgccccagggggaguucaccaucagccccaacaacacccccggcgacgugcuguucgaccuccagcugggcccgcaccugaaccccuuccucucccaccugagccagauguacaacgggugggugggcaacaugcgcguccggguggugcuggccgggaacgccuucacggccggcaaggucaucaucugcugcgugccgcccggguuccagucccgcacccucagcaucgcccaggcgacccuguucccccacgugaucgccgacguccggacccuggaccccguggaggugccccucgaggacguccgcaacgugcuguaccacaacaacgacacgcagcccaccaugcggcugcucugcaugcuguacaccccgcugcgcaccggcggcgccuccgggggcacggacagcuucguggucgccgggcgggugcugaccugccccggccccgacuucaacuuccucuuccuggugcccccgaccgucgagcagaagacccgccccuucacggugcccaacaucccccucaaguaccuguccaacagccggaucccgaaccccaucgagggcaugucccugagccccgaccagacccagaacgugcaguuccagaacgggcgcugcaccaucgacggccagccccucgggaccacgccggucuccgugagccagcugugcaaguuccggggccgcaucaccuccgggcagaagguccugaaccucaccgagcuggacggcagccccuucauggccuucgcggcccccgccccggugggcuuccccgaccugggguccugcgacuggcacaucgagaugagcaagauccccaacagcuccacccagagcaaccccaucguggucaacuccgugaagccgaacagccagcaguucgugccccaccucuccagcaucacgcuggacgacaacgucuccagcggcggggacuacaucggcaccauccaguggaccuccccgcccagcggguccggcggcgccaacaccaacuucuggaagauccccgacuacgggagcucccuggccgaggcgagccagcucgcccccgccguguacccgcccggcuucaacgaggugaucgucuacuucauggccuccauccccgggcccaaccagagcggcucccccaaccuggugcccugccugcucccgcaggaguacaucacgcacuucaucagcgagcaggcccccauccagggggaggcggcccugcugcacuacguggaccccgacaccaaccggaaccucggcgaguucaagcuguaccccggcggguaccugaccugcgucccgaacuccagcagcaccggcccccagcagcucccccuggacgggguguucguguucgccuccugggucagccgcuucuaccagcugaagcccgugggcacggccggcccggcgcgggggcgccucggcgugcggcgcuga

SEQ ID NO: 10163 - RNA, 1623 nt, Artificial Sequence
  derived and/or modified sequence opt1 from VP1__Norovirus__BAU16303
augaugauggccagcaaggacgugcccaccuccccggacggcgccagcggggcgggccagcugguccccgaggugaacaccgccgaccagaucuccauggaccccguggccggggccagcacggccgucgcgaccgccggccaggugaacaugaucgaccccuggaucuucaacaacuucgugcaggccccgcagggggaguucaccaucucccccaacaacacccccggcgacauccucuucgaccugcagcugggcccccaccucaacccguuccuggcccaccugagccagauguacaacgggugggucggcaacaugcgcgugcggauccuccuggcggggaacgccuucacggccggcaagaucaucaucugcugcgugccgcccggguucgacgcccgcauccugaccaucgcccaggcgacccucuucccccaccugaucgccgacguccggacccuggagcccguggagcucccccuggaggacgugcgcaacguccuguaccacaacuccagccagccccagcccacgaugcggcucguggccaugcuguacaccccgcugcgcaccggcggcggguccggcgggaccgacgccuucguggucgccggccgggugcucacgugccccgcgcccgacuucagcuuccuguuccuggugcccccguccgucgagcagaagacccgcguguucagcgugcccaacaucccccucaaggaccuguccaacagccggguccccacccugauccagggcauguucguguccccggacgugaaccagagcguccaguuccagaacgggcgcugccagaucgacggccagcuccaggggaccacgcccgugucccugagccagcugugcaagauccggggcaagaccuccagcaacacccgcguccucaaccugagcgagguggacgggacccccuucgugccccuggaguccccggcccccgucggcuuccccgacaucggcgggugcgacuggcacgugggcuucacguucgaggcccgggaccaggggccgagccagaacgugaccuucgccaccaacgacuccagcuucguccccuaccucggcuccaucagcccccacaacggggacggcuuccacuccggcgacaucaucgggagccuggacuggaucuccgcccccagcgacggcuccgcgcuggacguguggagcaucccgaaguacggguccagccuccccgacgugacccaccuggcccccgccgucuucccgcccggcuucggggaggugauccuguacuuccacuccaaguuccccggcagcggccccacggacaagcuccgcgugcccugccugaugccgcaggaguucaucacccacuucugcgacgagcaggcccccaucgccggggaggcggcccugcuccacuacgucgaccccgacgccggccggaaccugggggaguucaagcuguaccccgacggcuucaugaccugcgugccgaacuccaucagcuccggcccccagacccuccccaucaacgggguguucgucuucgugagcugggugagccgcuucuaccagcugaagcccgucggcacggccuccauggcgcggcgccuggggcuccggcgcaucuga

SEQ ID NO: 10164 - RNA, 1647 nt, Artificial Sequence
  derived and/or modified sequence opt1 from VP1__Norovirus__BAU16305
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccagguggugcuggccggcaacgcguucaccgccgggaagaucaucuucgccgccaucccgcccaacuucagcaccgacaaccucuccgccgcgcagaucaccaugugcccccacgugaucguggacguccgccagcuggagcccgugaaccugcccaugcccgacgugcggaacaacuucuuccacuacaaccagggcagcgacucccgccuccggcugaucgccaugcuguacacgccccuccgcgccaacaacagcggcgacgacgucuucaccguguccugccgggugcugacccgcccgagccccgacuucuccuucaacuuccuggucccgcccaccguggagagcaagacgaagcccuucacccuccccauccugaccaucuccgagaugagcaacucccgguuccccgugcccaucgacagccugcacaccuccccgacggagaacgucguggugcagugccagaacgggcgcgucacccucgacggcgagcugauggggaccacccagcugcuccccagccagaucugcgccuuccggggcgugcugacgcgcuccaccagccgggccagcgaccaggcggacaccgccgcgccccgccuguucaacuacuacuggcacauccagcucgacaaccugaacggcacccccuacgacccggccgaggacauccccgggccccugggcacgccggacuuccgggggaagguguucggcgucgccucccagcgcaaccccgacagcaccacccgggcccacgaggccaagguggacaccacggccgggcgcuucacccccaagcucggcucccuggagaucagcaccgaguccgacgacuucgaccagaaccagcccacccgguucacgccggucggcaucgggguggaccacgaggccgacuuccagcaguggagccugcccgacuacuccggccaguucacccacaacaugaaccucgcgcccgccguggcccccaacuucccgggggagcagcugcuguucuuccgcagccagcuccccuccagcggcgggcgguccaacggcauccuggacugccuggucccccaggagugggugcagcacuucuaccaggagagcgcccccgcccagacccagguggcgcucguccgcuacgugaacccggacaccggccgcgugcuguucgaggccaagcugcacaagcucggguucaugacgaucgccaagaacggcgacucccccaucaucgucccgcccgacggguacuuccgguucgagagcugggugaaccccuucuacacccuggcccccaugggcaucgggaacggccgccggcgcauccaguga

SEQ ID NO: 10165 - RNA, 1671 nt, Artificial Sequence
  derived and/or modified sequence opt1 from VP1__Norovirus__BAU16306
augaagauggccagcuccgacgccgcgcccagcgccgacggcgccgggaaccuggugccggagucccagcaggagguccucccccuggcccccguggccggcgcggcccuggccgcccccguggucgggcagaccaacaucaucgacccguggaucaaggagaacuucgugcaggcgccccagggcgaguucaccgugagccccaagaacucccccggggagauccucgucaaccuggagcugggcccgaagcucaaccccuaccuggaccaccugagccgcauguacaacuccuacgccggcgggaucgacgugauggugguccucgccggcaacgccuucacggccgggaaggugcugaucgcggccaucccgcccaacuuccccguggagggcgucagcgccucccaggccacccaguucccccacgugaucaucgacgugcggacccuggaccccguccgccucccccugccggacgugcggagcaccuucuuccacuacacgaacgacaccgagcccaagaugcgccuggugaucuggcucuacacgccccugcggaccaacggguccggcgacgacagcuucaccgucuccggccgcauccugacccggcccagccaggacuucgaguucgccuuccucaucccgcccaccguggagaccaagacgacccccuucuccgugcccggguucagcguccaggagauguccaacagccgcuggccggcggccaucuccgccaugguggugcggggcaacgagccccaggucgugcaguuccagaacgggcgcgcccaccuggacggcaugcugcucggcaccacccccgucagccccaacuacaucgccagcuaccgggggaucuccacgggcaacagccgcuccgcgagcccggaggccgacgagcgggccgugggguccuucgacguguggauccgccugcaggagcccgacggccagcccuacgacaucuucgggaagcagccggcccccaucggcacccccgacuucaaggccgucaucgugggcuucgcggcccggccccugaccagcggguccuacgccaacgaggccuacgugaacaccacggcgagcgacuacgccccggccaccggcaacaugcgcuucaccguccggaacgggggcuccgggcacaucagcgccaacaaguacugggaguucaaguccuucggcguggagggcgagcgccacaccgacauccaguaccaggaguacgagcuccccgacuacagcggccagguggccuccaaccacaaccuggcgccgcccgucgcgccccggaugcccggggagagccugcuccuguuccaguccaacaugcccgugugggacgacgggcacggcgagagcacgcccaagaagauccacugccugcucccgcaggaguucaucgggcacuucuucgacaagcaggcccccucccugggcgacgccgcccugcuccgcuacgugaaccaggagaccaaccggguccuguucgagugcaagcuguaccgcgacggcuacaucaccguggccgccagcuccgggcuccuggacuucccccuggacggcuucuuccgcuucgacagcugggugagcuccuucuacauccucagccccgucggguccggccagggccggcgcgggcgggugcgcuuccaguga

SEQ ID NO: 10166 - RNA, 1626 nt, Artificial Sequence
  derived and/or modified sequence opt1 from VP1__Norovirus__BAU16307
augaugauggccagcaaggacgccacccccuccgcggacggcgccaacggggccggccagcuggugccggaggucaacaacgccgagccccucccccuggaccccguggccggggcgagcaccgcccuggccacggccggccaggugaacaugaucgacccguggaucuucaacaacuucguccaggcgccccagggggaguucaccaucucccccaacaacacccccggcgacauccucuucgaccugcagcugggcccgcaccucaaccccuuccuggcccaccugagccagauguacaacgggugggugggcaacaugcgcgugcgggucauccucgccgggaacgccuucaccgccggcaaggugaucaucugcugcgugccgcccggguuccagucccgcacgcugagcaucgcgcaggccacccuguucccccacgucaucgccgacgugcggacccucgagccccuggagaucccccuggaggacgugcgcaacacccucuaccacaacaacgacucccagcccacgaugcggcugcugugcaugcucuacaccccgcugcgcaccggcggcgggagcggcgggaccgacgccuucgucguggccggccgggugcugacgugccccucccccgacuucaacuuccucuuccuggugcccccgaccgucgagcagaagacccgccccuucagcgugcccaacaucccccugcagaaccucuccaacagccgggucccgucccugauccagagcauggugcuguccagcgaccacgcgcagaccgugcaguuccagaacggccgcugcacgaccgacgggcaccuccugggcaccacccccgucuccagcgggcagcugaugaaguuccggggcaaggugacgcccggguccaaggugcucaaccugaccgagcuggacggcagccccuuccucgccuucgagccgcccgcccccgccggcuucccggaccuggggaagugcgacuggcacaucgagaugagccuguaccaggucaacaaccaggacaaccccaucgugcuccgcgccaucgagcccaacuccagcuccuucgucccccaccugggcagcguguccuucaaccagaacguggacgcggccggggacuacgucugcaccauccaguacaccagcccgcccuccaacagccacgacgccgacguggacuucugguccauccccgacuacggcagcaaccuggccgaggccucccagcucgcgcccguggucuacccgcccggguucggcgaggccaucguguacuucaugagccgggugcccggcuggaaccgcacgaaccggcugaaccugguccccugccuccugccgcaggaguucaucgggcacuucguguccgagcaggcccccgccaucggcgaggcggcccugcuccacuacguggaccccgacaccaaccgcaaccugggggaguucaagcuguaccccgagggcuucaucacgugcgucccgaacgggaccggcccccagcagcucccccugaacggcguguucguguucagcuccugggucagccgguucuaccagcugaagcccguggggaccgccuccagcgcccgcggccggcuggggauccgccgguga

SEQ ID NO: 10167 - RNA, 1623 nt, Artificial Sequence; identical to SEQ ID NO: 9493
  derived and/or modified sequence opt1 from VP1__Norovirus__BAU24831

SEQ ID NO: 10168 - RNA, 1623 nt, Artificial Sequence; identical to SEQ ID NO: 9445
  derived and/or modified sequence opt1 from VP1__Norovirus__BAU24834

SEQ ID NO: 10169 - RNA, 1623 nt, Artificial Sequence
  derived and/or modified sequence opt1 from VP1__Norovirus__BAU24837
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccaucccccuggagaagcuguucaccggccccagcuccgccuucgucgugcagccgcagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgaccccaccgaggagaucccggcgccccuggggacgcccgacuucgugggcaagauccaggggguccucacccagaccacccggacggacggcuccacccgcgggcacaaggccaccguguacaccggcagcgccgacuucgugcccaagcugggccggguccaguucgagacggacaccgaccgcgacuucgaggccaaccagaacaccaaguucaccccggugggggugauccaggacggcuccacgacccaccggaacgagccccagcaguggguccugcccagcuacuccgggcgcaacacccccaacgugcaccucgccccggccguggcgcccaccuuccccggcgagcagcugcuguucuuccggagcacgaugcccgggugcuccggcuacccgaacauggaccucgacugccugcugccccaggaguggguccaguacuucuaccaggaggccgcccccgcccagagcgacguggcgcuccugcgcuucgugaaccccgacaccggccggguccuguucgagugcaagcuccacaaguccggguacgugaccguggcccacaccggccagcacgaccuggucaucccgcccaacggguacuuccgcuucgacagcugggugaaccaguucuacacccuggcccccaugggcaacgggacgggccgccggcgcgcccucuga

SEQ ID NO: 10170 - RNA, 1623 nt, Artificial Sequence
  derived and/or modified sequence opt1 from VP1__Norovirus__BAU24840
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcugcuggggaccacccagcucucccccgucaacaucugcacccugcggggcgacgugacgcacaucaccggcagccgcaacuacaccaugaaccuggccucccagaacuggagcaacuacgacccgaccgaggagauccccgcgccccucgggacgcccgacuucgugggcaagauccaggggguccugacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcuccccuccuacagcgggcgcaacaccccgaacguccaccuggcccccgcgguggcccccaccuuccccggcgagcagcuccucuucuuccgguccacgaugccggggugcagcggcuaccccaacauggaccuggacugccugcucccccaggagugggugcaguacuucuaccaggaggccgcccccgcgcaguccgacgucgcccugcugcgcuucgugaacccggacaccggccggguccucuucgagugcaagcugcacaagagcggguacgugaccguggcccacaccggccagcacgaccuggugaucccgcccaacggguacuuccgcuucgacuccugggucaaccaguucuacacccucgcccccaugggcaacgggacgggccgccggcgcgcccuguga

SEQ ID NO: 10171 - RNA, 1623 nt, Artificial Sequence; identical to SEQ ID NO: 9445
  derived and/or modified sequence opt1 from VP1__Norovirus__BAU24843

SEQ ID NO: 10172 - RNA, 1623 nt, Artificial Sequence
  derived and/or modified sequence opt1 from VP1__Norovirus__BAU24846
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucgagacggacaccgagaacgacuucgagacccaccagaacaccaaguucacgcccgugggcgucauccaggacgggggcaccacccaccgcaacgagccccagcagugggugcuccccuccuacagcgggcggaacgugccgaacguccaccuggcccccgccguggcgcccaccuuccccggcgagcagcuccucuucuuccgcuccaucaugccgggcugcagcggguaccccaacauggaccuggacugccugcucccccaggagugggugcagcacuucuaccaggaggccgcccccgcccaguccgacgucgcgcugcugcgguucgugaacccggacacgggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacggcaccgggcgccggcgcgcccuguga

SEQ ID NO: 10173 - RNA, 1623 nt, Artificial Sequence; identical to SEQ ID NO: 9445
  derived and/or modified sequence opt1 from VP1__Norovirus__BAU24849

SEQ ID NO: 10174 - RNA, 1623 nt, Artificial Sequence
  derived and/or modified sequence opt1 from VP1__Norovirus__BAU24852
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccgcgacuucgaggccaaccagaacaccaaguucacccccgucggggugauccaggacggcuccacgacccaccggaacgagccccagcagugggugcugcccagcuacuccgggcgcaacacccacaacguccaccucgccccggcgguggcccccaccuuccccggcgagcagcugcuguucuuccggagcacgaugcccgggugcuccggcuacccgaacauggaccucgacugccugcugccccaggagugggugcaguacuucuaccaggaggccgcccccgcgcagagcgacgucgcccuccugcgcuucgugaaccccgacaccggccgggugcuguucgagugcaagcuccacaaguccggguacgucaccguggcccacaccggccagcacgaccuggugaucccgcccaacggguacuuccgcuucgacagcugggucaaccaguucuacacccuggcccccaugggcaacgggacgggccgccggcgcgccguguga

SEQ ID NO: 10175 - RNA, 1623 nt, Artificial Sequence; identical to SEQ ID NO: 10172
  derived and/or modified sequence opt1 from VP1__Norovirus__BAU24855

SEQ ID NO: 10176 - RNA, 1623 nt, Artificial Sequence; identical to SEQ ID NO: 9493
  derived and/or modified sequence opt1 from VP1__Norovirus__BAU24858

SEQ ID NO: 10177 - RNA, 1623 nt, Artificial Sequence
  derived and/or modified sequence opt1 from VP1__Norovirus__BAU24861
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucgagacggacaccgagaacgacuucgagacccaccagaacaccaaguucacgcccgugggcgucauccaggacgggggcaccacccaccgcaacgagccccagcagugggugcuccccuccuacagcgggcggaacgugccgaacguccaccuggcccccgccguggcgcccaccuuccccggcgagcagcuccucuucuuccgcuccacgaugccgggcugcagcggguaccccaacauggaccuggacugccugcucccccaggagugggugcagcacuucuaccaggaggccgcccccgcccaguccgacgucgcgcugcugcgguucgugaacccggacaccggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacggcacggggcgccggcgcgcccuguga

SEQ ID NO: 10178 - RNA, 1623 nt, Artificial Sequence; identical to SEQ ID NO: 9445
  derived and/or modified sequence opt1 from VP1__Norovirus__BAU24864

SEQ ID NO: 10179 - RNA, 1623 nt, Artificial Sequence
  derived and/or modified sequence opt1 from VP1__Norovirus__BAU24867
augaagauggccagcuccgacgccaaccccaccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaaggugaucuucgccgccgugccgcccaacuucccgaccgaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcacgaagcccuucagcgugcccguccugaccguggaggagaugaccaacucccgguuccccaucccccuggagaagcuguucaccggcccgagcuccgccuucgucgugcagccccagaacgggcgcugcacgaccgacggcgugcuccuggggaccacccagcucagccccgucaacaucugcacguuccggggcgacgugacccacaucaccggcucccgcaacuacaccaugaaccuggccagccagaacugguccaacuacgacccgacggaggagauccccgcgccccuggggacccccgacuucgugggcaagauccaggggguccucacccagaccacgcggaccgacggcagcacccgcgggcacaaggccaccguguacacgggcagcgccgacuucgccccgaagcugggccgggugcaguucgagaccgacaccgaccacgacuucgaggccaaccagaacaccaaguucacgcccgucggggugauccaggacggcuccaccacccaccgcaacgagccccagcagugggugcugcccagcuacuccgggcggaacaccccgaacguccaccucgcccccgcgguggcccccacguuccccggcgagcagcugcuguucuuccgcagcaccaugccggggugcuccggcuaccccaacauggaccucgacugccugcugccccaggagugggugcaguacuucuaccaggaggccgcccccgcgcagagcgacgucgcccuccugcgguucgugaacccggacaccggccgcgugcuguucgagugcaagcuccacaaguccggguacgucaccguggcccacaccggccagcacgaccuggugaucccgcccaacggguacuuccgguucgacagcugggucaaccaguucuacacgcuggcccccaugggcaacgggaccggccgccgccgggcccucuga

SEQ ID NO: 10180 - RNA, 1623 nt, Artificial Sequence; identical to SEQ ID NO: 9493
  derived and/or modified sequence opt1 from VP1__Norovirus__BAU24870

SEQ ID NO: 10181 - RNA, 1623 nt, Artificial Sequence; identical to SEQ ID NO: 9445
  derived and/or modified sequence opt1 from VP1__Norovirus__BAU24873

SEQ ID NO: 10182 - RNA, 1623 nt, Artificial Sequence; identical to SEQ ID NO: 9445
  derived and/or modified sequence opt1 from VP1__Norovirus__BAU24876

SEQ ID NO: 10183 - RNA, 1623 nt, Artificial Sequence; identical to SEQ ID NO: 9445
  derived and/or modified sequence opt1 from VP1__Norovirus__BAU24879

SEQ ID NO: 10184 - RNA, 1623 nt, Artificial Sequence
  derived and/or modified sequence opt1 from VP1__Norovirus__BAU24882
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgagaccaaccagaacaccaaguucacgcccgucggggugauccaggacggcgggaccacccaccgcaacgagccccagcagugggugcugcccuccuacagcggccggaacaccccgaacguccaccucgcccccgccguggcgcccacguuccccggggagcagcugcuguucuuccgcuccaccaugccgggcugcagcggcuaccccaacauggaccucgacugccugcugccccaggagugggugcaguacuucuaccaggaggccgcccccgcccaguccgacgucgcgcuccugcgguucgugaacccggacaccgggcgcgugcuguucgagugcaagcuccacaagagcggcuacgucaccguggcccacaccgggcagcacgaccuggugaucccgcccaacggcuacuuccgguucgacuccugggucaaccaguucuacacgcuggcccccauggggaacggcaccggccgccgccgggcccucuga

SEQ ID NO: 10185 - RNA, 1623 nt, Artificial Sequence
  derived and/or modified sequence opt1 from VP1__Norovirus__BAU24885
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccgggacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccgccgggccguguga

SEQ ID NO: 10186 - RNA, 1623 nt, Artificial Sequence; identical to SEQ ID NO: 9445
  derived and/or modified sequence opt1 from VP1__Norovirus__BAU24888

SEQ ID NO: 10187 - RNA, 1623 nt, Artificial Sequence
  derived and/or modified sequence opt1 from VP1__Norovirus__BAU24891
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucgccacggacaccgagaacgacuucgagacccaccagaacaccaaguucacgcccgugggcgucauccaggacgggggcaccacccaccgcaacgagccccagcagugggugcuccccuccuacagcgggcggaacgugccgaacguccaccuggcccccgcgguggcccccaccuuccccggcgagcagcuccucuucuuccgcuccacgaugccgggcugcagcggguaccccaacauggaccuggacugccugcucccccaggagugggugcagcacuucuaccaggaggccgcccccgcgcaguccgacgucgcccugcugcgguucgugaacccggacaccggccgcguccucuucgagugcaagcugcacaagagcggguacgugaccguggcccacaccggccagcacgaccuggugaucccgcccaacggguacuuccgguucgacuccugggucaaccaguucuacacccucgcccccaugggcaacggcacggggcgccggcgcgcccuguga

SEQ ID NO: 10188 - RNA, 1623 nt, Artificial Sequence; identical to SEQ ID NO: 9493
  derived and/or modified sequence opt1 from VP1__Norovirus__BAU24894

SEQ ID NO: 10189 - RNA, 1623 nt, Artificial Sequence
  derived and/or modified sequence opt1 from VP1__Norovirus__BAU24897
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgugccgaagcugggccggguccaguucgagacggacaccgaccacgacuucgaggccaaccagaacaccaaguucacccccgugggggugauccaggacggcagcacgacccaccgcaacgagccccagcaguggguccugcccuccuacagcgggcggaacaccccgaacgugcaccucgcccccgccguggcgcccaccuuccccggcgagcagcugcuguucuuccgcuccacgaugccggggugcagcggcuaccccaacauggaccucgacugccugcugccccaggaguggguccaguacuucuaccaggaggccgcccccgcccaguccgacguggcgcuccugcgguucgugaacccggacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccgggcccucuga

SEQ ID NO: 10190 - RNA, 1623 nt, Artificial Sequence; identical to SEQ ID NO: 9445
  derived and/or modified sequence opt1 from VP1__Norovirus__BAU24900

SEQ ID NO: 10191 - RNA, 1623 nt, Artificial Sequence; identical to SEQ ID NO: 9445
  derived and/or modified sequence opt1 from VP1__Norovirus__BAU24903

SEQ ID NO: 10192 - RNA, 1623 nt, Artificial Sequence; identical to SEQ ID NO: 9733
  derived and/or modified sequence opt1 from VP1__Norovirus__BAU24906

SEQ ID NO: 10193 - RNA, 1623 nt, Artificial Sequence; identical to SEQ ID NO: 9445
  derived and/or modified sequence opt1 from VP1__Norovirus__BAU24909

SEQ ID NO: 10194 - RNA, 1623 nt, Artificial Sequence; identical to SEQ ID NO: 9493
  derived and/or modified sequence opt1 from VP1__Norovirus__BAU24912

SEQ ID NO: 10195 - RNA, 1623 nt, Artificial Sequence
  derived and/or modified sequence opt1 from VP1__Norovirus__BAU24915
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcagcaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaccggcagcgccaacuucgccccgaagcugggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacaccccgaacguccaccucgcccccgcgguggcccccaccuuccccggcgagcagcugcuguucuuccgcagcacgaugccggggugcuccggcuaccccaacauggaccucgacugccugcugccccaggagugggugcaguacuucuaccaggaggccgcccccgcgcagagcgacgucgcccuccugcgguucgugaacccggacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgggcccucuga

SEQ ID NO: 10196 - RNA, 1623 nt, Artificial Sequence; identical to SEQ ID NO: 9445
  derived and/or modified sequence opt1 from VP1__Norovirus__BAU24918

SEQ ID NO: 10197 - RNA, 1623 nt, Artificial Sequence; identical to SEQ ID NO: 9445
  derived and/or modified sequence opt1 from VP1__Norovirus__BAU24921

SEQ ID NO: 10198 - RNA, 1623 nt, Artificial Sequence; identical to SEQ ID NO: 9445
  derived and/or modified sequence opt1 from VP1__Norovirus__BAU24924

SEQ ID NO: 10199 - RNA, 1623 nt, Artificial Sequence
  derived and/or modified sequence opt1 from VP1__Norovirus__BAU24927
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggagcucgacugccugcugccccaggagugggugcaguacuucuaccaggaggccgcccccgcgcagagcgacgucgcccuccugcgguucgugaacccggacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgggcccucuga

SEQ ID NO: 10200 - RNA, 1623 nt, Artificial Sequence
  derived and/or modified sequence opt1 from VP1__Norovirus__BAU24930
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucaucguggacgugcggcagcuggagcccguccucaucccgcugcccgacgugcgcaacaacuucuaccacuacaaccaguccaacgacagcaccaucaagcugaucgccaugcucuacacgccccugcgggcgaacaacgccggcgacgacguguucaccgucuccugccgcgugcugacccggcccagcccggacuucgacuucaucuuccucgugccgcccaccgucgagucccgcaccaagcccuucagcgugcccgugcugacggucgaggagaugaccaacucccgguuccccaucccccuggagaagcuguucaccggccccagcuccgccuucgugguccagccgcagaacgggcgcugcaccacggacggcgugcuccuggggaccacccagcucagccccgugaacaucugcaccuuccggggcgacgucacgcacaucaccggcucccgcaacuacaccaugaaccuggccagccagaacuggaacaacuacgaccccaccgaggagaucccggcgccccuggggacgcccgacuucgugggcaagauccaggggaugcucacccagaccacccggacggacggcagcacccgcgggcacaaggccaccguguacaccggcuccgccgacuucgcccccaagcugggccggguccaguucgagacggacaccgaccacgacuucgaggccaaccagaacaccaaguucaccccggugggggugauccaggacggcagcacgacccaccgcaacgagccccagcaguggguccugcccuccuacagcgggcggaacacccacaacgugcaccucgcccccgcgguggccccgaccuuccccggcgagcagcugcuguucuuccgcuccacgaugcccgggugcagcggcuaccccaacauggaccucgacugccugcugccgcaggaguggguccaguacuucuaccaggaggccgcccccgcgcaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcccccaugggcaacgggacgggccgccgccggguggucuga

SEQ ID NO: 10201 - RNA, 1623 nt, Artificial Sequence; identical to SEQ ID NO: 9405
  derived and/or modified sequence opt1 from VP1__Norovirus__BAU24933

SEQ ID NO: 10202 - RNA, 1623 nt, Artificial Sequence
  derived and/or modified sequence opt1 from VP1__Norovirus__BAU24936
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucggcacggacaccgagaacgacuucgagacccaccagaacaccaaguucacgcccgucggggugauccaggacggcgggaccacccaccgcaacgagccccagcagugggugcuccccuccuacagcggccggaacgucccgaacgugcaccuggcccccgccguggcgcccaccuuccccggcgagcagcuccucuucuuccgcuccacgaugccggggugcagcggcuaccccaacauggaccuggacugccugcucccccaggaguggguccagcacuucuaccaggaggccgcccccgcccaguccgacguggcgcugcugcgguucgugaacccggacaccgggcgcguccucuucgagugcaagcugcacaagcccggcuacgugaccguggcccacaccgggcagcacgaccuggucaucccgcccaacggcuacuuccgguucgacagcugggugaaccaguucuacacccucgcccccaugggcaacgggacgggccgccggcgcgcccuguga

SEQ ID NO: 10203 - RNA, 1623 nt, Artificial Sequence
  derived and/or modified sequence opt1 from VP1__Norovirus__BAU24942
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagacgcccgcgccccuggggacccccgacuucgugggcaagauccaggggguccucacccagaccacgcggaccgacggcagcacccgcgggcacaaggccaccguguacacgggcuccgccgacuucgccccgaagcugggccgggugcaguucgagaccgacaccgaccgcgacuucgaggccaaccagaacaccaaguucacgcccgucggggugauccaggacggcagcaccacccaccggaacgagccccagcagugggugcugcccuccuacagcgggcgcaacaccccgaacguccaccucgcccccgcgguggcccccacguuccccggcgagcagcugcuguucuuccgguccaccaugccggggugcagcggcuaccccaacauggaccucgacugccugcugccccaggagugggugcaguacuucuaccaggaggccgcccccgcgcaguccgacgucgcccuccugcgcuucgugaacccggacaccggccgggugcuguucgagugcaagcuccacaagagcggguacgucaccguggcccacaccggccagcacgaccuggugaucccgcccaacggguacuuccgcuucgacuccugggucaaccaguucuacacgcuggcccccaugggcaacgggaccggccgccggcgcgcccucuga

SEQ ID NO: 10204 - RNA, 1623 nt, Artificial Sequence
  derived and/or modified sequence opt1 from VP1__Norovirus__BAU24945
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagacgcccgcgccccuggggacccccgacuucgugggcaagauccaggggguccucacccagaccacgcggaccgacggcagcacccgcgggcacaaggccaccguguacacgggcuccgccgacuucgccccgaagcugggccgggugcaguucgagaccgacaccgaccacgacuucgaggccaaccagaacaccaaguucacgcccgucggggugauccaggacggcagcaccacccaccgcaacgagccccagcagugggugcugcccuccuacagcgggcggaacaccccgaacguccaccucgcccccgcgguggcccccacguuccccggcgagcagcugcuguucuuccgcuccaccaugccggggugcagcggcuaccccaacauggaccucgacugccugcugccccaggagugggugcaguacuucuaccaggaggccgcccccgcgcaguccgacgucgcccuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacgcuggcccccaugggcaacgggaccggccgccgccgggcccucuga

SEQ ID NO: 10205 - RNA, 1623 nt, Artificial Sequence
  derived and/or modified sequence opt1 from VP1__Norovirus__BAU24948
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcagcacggcccaccgcaacgagccccagcagugggugcugcccuccuacagcgggcggaacaccccgaacguccaccucgcgcccgccguggcccccaccuuccccggcgagcagcugcuguucuuccgcuccaccaugccggggugcagcggcuaccccaacauggaccucgacugccugcugccccaggagugggugcaguacuucuaccaggaggccgcgcccgcccaguccgacgucgcccuccugcgguucgugaacccggacacgggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccgccgggcgcucuga

SEQ ID NO: 10206 - RNA, 1623 nt, Artificial Sequence; identical to SEQ ID NO: 8842
  derived and/or modified sequence opt1 from VP1__Norovirus__BAU24950

SEQ ID NO: 10207 - RNA, 1623 nt, Artificial Sequence; identical to SEQ ID NO: 9767
  derived and/or modified sequence opt1 from VP1__Norovirus__BAU24952

SEQ ID NO: 10208 - RNA, 1623 nt, Artificial Sequence
  derived and/or modified sequence opt1 from VP1__Norovirus__BAU24954
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccugggggcccccgacuucgugggcaagauccaggggaugcucacgcagaccacccgggccgacggcagcacccgcgggcacaaggccacggucuacaccggcagcgccgacuucgccccgaagcugggccgggugcaguucgagaccgacaccgaccacgacuucgaggcgaaccagaacacgaaguucacccccgugggggucauccaggacggcuccaccacccaccgcaacgagccccagcagugggugcugcccagcuacuccgggcggaacacgcacaacgugcaccucgccccggccgucgcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacguggcccuccugcgguucgucaaccccgacaccggccgcgugcuguucgagugcaagcuccacaaguccggguacgugacggucgcccacaccggccagcacgaccuggugaucccgcccaacggguacuuccgguucgacagcugggugaaccaguucuacacccuggcgcccaugggcaacggggccggccgccgccgggucguguga

SEQ ID NO: 10209 - RNA, 1623 nt, Artificial Sequence; identical to SEQ ID NO: 9445
  derived and/or modified sequence opt1 from VP1__Norovirus__BAU24958

SEQ ID NO: 10210 - RNA, 1623 nt, Artificial Sequence
  derived and/or modified sequence opt1 from VP1__Norovirus__BAU24960
augaagauggccagcaacgacgccaaccccuccgacggcccggcggccaaccuggugcccgaggucaacaacgaggugauggcccucgagcccguggucggggccgccaucgcggcccccguggccggccagcagaacgugaucgacccguggauccgcaacaacuucguccaggcccccgggggcgaguucaccgugagcccccggaacgcgcccggggagauccugugguccgccccgcugggccccgaccucaaccccuaccugagccaccuggcccgcauguacaacggcuacgccgggggcuucgaggugcaggucauccucgccgggaacgcguucaccgccggcaagaucaucuucgccgccgugcccccgaacuuccccacggaggggcugucccccagccaggugaccauguucccccacaucaucgucgacgugcggcagcuggagccggugcucaucccccugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcaccaagcccuucacgguccccauccugaccguggaggagaugaccaacagccgguuccccaucccccuggagaagcuguucaccggcccguccagcgccuucgugguccagccccagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgacccgaccgaggagauccccgcgccccucgggacgcccgacuucgugggcaagauccaggggaugcugacccagaccaccaagggcgacgggagcacgcggggccacaaggccaccgucuacaccggcuccgccccguucacccccaagcuggggagcgugcaguucgagacggacaccgagaacgacuucgagacccaccagaacaccaaguucacgcccgugggcgucauccaggacgggggcaccacccaccgcaacgagccccagcagugggugcucccgagcuacuccgggcggaacgugcccaacguccaccuggcccccgccguggcgcccaccuucccgggcgagcagcuccucuucuuccgcagcaucaugcccggcugcuccggguaccccaacauggaccuggacugccugcucccccaggagugggugcagcacuucuaccaggaggccgccccggcccagagcgacgucgcgcugcugcgguucgugaaccccgacacgggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcaccgggcgccggcgcgcccuguga

SEQ ID NO: 10211 - RNA, 1623 nt, Artificial Sequence; identical to SEQ ID NO: 9493
  derived and/or modified sequence opt1 from VP1__Norovirus__BAU24962

SEQ ID NO: 10212 - RNA, 1623 nt, Artificial Sequence; identical to SEQ ID NO: 10172
  derived and/or modified sequence opt1 from VP1__Norovirus__BAU24964

SEQ ID NO: 10213 - RNA, 1623 nt, Artificial Sequence; identical to SEQ ID NO: 10172
  derived and/or modified sequence opt1 from VP1__Norovirus__BAU24966

SEQ ID NO: 10214 - RNA, 1623 nt, Artificial Sequence
  derived and/or modified sequence opt1 from VP1__Norovirus__BAU24968
augaagauggccagcuccgacgccaaccccagcgacggcuccaccgcgaaccuggugcccgaggucaacaacgaggugauggcccucgagcccgugaucggggccgccaucgccgcgcccgucgccggccagcagaacgugaucgaccccuggauccgcaacaacuucgugcaggcccccgggggcgaguucaccgucagcccccggaacgcccccggggagauccugugguccgcgccccugggcccggaccucaaccccuaccugagccaccugucccgcauguacaacggcuacgccgggggcuucgagguccaggugauccucgccgggaacgccuucacggccggcaagaucaucuucgcggccgugccgcccaacuucccgaccgaggggcugagccccucccaggugaccauguucccccacaugaucguggacguccggcagcuggagcccgugcucaucccgcugcccgacgugcgcaacaacuucuaccacuacaaccagagcaacgacuccaccaucaagcugaucgccaugcucuacacgccccugcgggccaacaacgccggcgacgacgucuucaccgugagcugccgcgugcugacccggcccuccccggacuucgacuucaucuuccucgucccgcccaccguggagagccgcacgaagcccuucuccgugcccguccugaccguggaggagaugaccaacagccgguuccccaucccccuggagaagcuguucaccggccccuccagcgcguucgugguccagccgcagaacgggcgcugcacgaccgacggcgugcuccuggggaccacccagcucucccccgucaacaucugcacguuccggggcgacgugacccacauccccggcagccgcaacuacaccaugaaccuggccagccagaacuggaacuccuacgacccgaccgaggagauccccgcgccccuggggacgcccgacuucgugggcaagauccaggggguccucacccagaccacccggacgaacggcagcacccgcgggcacaaggccaccguguacaccggcuccgccgacuucagcccgaagcugggccgggugcaguucgccacggacaccgacaacgacuucgagaccaaccagaacaccaaguucacgcccgucggggugauccaggacggcuccaccacgccccgcaacgagccccagcagugggugcugccgagcuacuccgggcggaacauccacaacguccaccucgcccccgccguggcccccaccuuccccggcgagcagcugcuguucuuccgcagcaccaugccggggugcuccggcuaccccaacauggaccucgacugccugcugccccaggagugggugcaguacuucuaccaggaggccgcgcccgcccagagcgacgucgcccuccugcgguucgugaacccggacaccggccgcgugcuguucgagugcaagcuccacaaguccggguacgucaccguggcccacaccggccagcacgaccuggugaucccgcccaacggguacuuccgguucgacagcugggucaaccaguucuacacccuggcgcccaugggcaacgggacgggccgccgccgggcccucuga

SEQ ID NO: 10215 - RNA, 1623 nt, Artificial Sequence
  derived and/or modified sequence opt1 from VP1__Norovirus__BAU24972
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacaucacgcacaucaccggcagccgcaacuacaccaugaaccuggccucccagaacuggagcaacuacgacccgaccgaggagauccccgcgccccuggggacgcccgacuucgugggcaagauccagggggugcucacccagaccacccggacggacggcagcacccgcgggcacaaggccaccgucuacaccggcuccgccgacuucgccccgaagcugggccgggugcaguucgagacggacaccgaccacgacuucgaggccaaccagaacaccaaguucacccccgugggggucauccaggacggcagcacgacccaccgcaacgagccccagcagugggugcugcccuccuacagcgggcggaacaccccgaacgugcaccucgcccccgcggucgcccccaccuuccccggcgagcagcugcuguucuuccgcuccacgaugccggggugcagcggcuaccccaacauggaccucgacugccugcugccccaggagugggugcagcacuucuaccaggaggccgcccccgcgcaguccgacguggcccuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgggcccucuga

SEQ ID NO: 10216 - RNA, 1623 nt, Artificial Sequence
  derived and/or modified sequence opt1 from VP1__Norovirus__BAU24974
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcugcccuccuacagcgggcgcaccaccccgaacguccaccucgcccccgcgguggcccccacguuccccggcgagcagcugcuguucuuccgguccaccaugccggggugcagcggcuaccccaacauggaccucgacugccugcugccccaggagugggugcaguacuucuaccaggaggccgcccccgcgcaguccgacgucgcccuccugcgcuucgugaacccggacaccggccgggugcuguucgagugcaagcuccacaagagcggguacgucaccguggcccacaccggccagcacgaccuggugaucccgcccaacggguacuuccgcuucgacuccugggucaaccaguucuacacgcuggcccccaugggcaacgggaccggccgccggcgcgcccucuga

SEQ ID NO: 10217 - RNA, 1623 nt, Artificial Sequence; identical to SEQ ID NO: 9501
  derived and/or modified sequence opt1 from VP1__Norovirus__BAU24976

SEQ ID NO: 10218 - RNA, 1623 nt, Artificial Sequence; identical to SEQ ID NO: 9493
  derived and/or modified sequence opt1 from VP1__Norovirus__BAU24978

SEQ ID NO: 10219 - RNA, 1623 nt, Artificial Sequence; identical to SEQ ID NO: 9493
  derived and/or modified sequence opt1 from VP1__Norovirus__BAU24980

SEQ ID NO: 10220 - RNA, 1623 nt, Artificial Sequence
  derived and/or modified sequence opt1 from VP1__Norovirus__BAU24982
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccaacuucgccccgaagcugggccggauccaguucgagacggacaccgaccacgacuucgaggccaaccagaacaccaaguucacccccgugggggucauccaggacggcagcacgacccaccgcaacgagccccagcagugggugcugcccuccuacagcgggcggaacaccccgaacgugcaccucgcccccgcggucgcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacguggcccuccugcgguucgucaacccggacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcccccaugggcaacgggacgggccgccgccgggcccucuga

SEQ ID NO: 10221 - RNA, 1623 nt, Artificial Sequence; identical to SEQ ID NO: 9493
  derived and/or modified sequence opt1 from VP1__Norovirus__BAU24984

SEQ ID NO: 10222 - RNA, 1623 nt, Artificial Sequence; identical to SEQ ID NO: 9445
  derived and/or modified sequence opt1 from VP1__Norovirus__BAU24986

SEQ ID NO: 10223 - RNA, 1623 nt, Artificial Sequence
  derived and/or modified sequence opt1 from VP1__Norovirus__BAU24988
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggaugcugacccagaccaccaagggcgacggguccacgcggggccacaaggccaccgucuacaccggcagcgcccccuucaccccgaagcuggggagcgugcaguucgagacggacaccgagaacgacuucgagacccaccagaacaccaaguucacgcccgugggcgucauccaggacgggggcaccacccaccgcaacgagccccagcagugggugcuccccuccuacagcgggcggaacgugccgaacguccaccuggcccccgccguggcgcccaccuuccccggcgagcagcuccucuucuuccgcuccacggugccgggcugcagcggguaccccaacauggaccuggacugccugcucccccaggaguggguccagcacuucuaccaggaggccgcccccgcccaguccgacguggcgcugcugcgguucgugaacccggacaccggccgcguccucuucgagugcaagcugcacaagagcggguacgugaccguggcccacaccggccagcacgaccuggucaucccgcccaacggguacuuccgguucgacuccugggugaaccaguucuacacccucgcccccaugggcaacggcacggggcgccggcgcgcccuguga

SEQ ID NO: 10224 - RNA, 1623 nt, Artificial Sequence
  derived and/or modified sequence opt1 from VP1__Norovirus__BAU24990
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggaacaacuacgacccgaccgaggagauccccgcgccccuggggacgcccgacuucgugggcaagauccaggggguccucacccagaccacccgcacggacggcagcacccgggggcacaaggccaccguguacaccggcagcgccgacuucgccccgaagcugggccgcgugcaguucgagacggacaccgaccacgacuucgaggccaaccagaacaccaaguucacccccgucggggugauccaggacggcgggacgacccaccggaacgagccccagcagugggugcugcccuccuacagcggccgcaacacccacaacguccaccucgccccggcgguggcccccaccuuccccggggagcagcugcuguucuuccgguccacgaugcccggcugcagcggcuacccgaacauggaccucgacugccugcugccccaggagugggugcaguacuucuaccaggaggccgcccccgcgcaguccgacgucgcccuccugcgcuucgugaaccccgacaccgggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcacgggccggcgccgcgccguguga

SEQ ID NO: 10225 - RNA, 1623 nt, Artificial Sequence
  derived and/or modified sequence opt1 from VP1__Norovirus__BAU24992
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcugcccuccuacagcgggcgcuacaccccgaacguccaccucgcccccgcgguggcccccaccuuccccggcgagcagcugcuguucuuccgguccacgaugccggggugcagcggcuaccccaacauggaccucgacugccugcugccccaggagugggugcaguacuucuaccaggaggccgcccccgcgcaguccgacgucgcccuccugcgcuucgugaacccggacaccggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggacgggccgccggcgcgcccucuga

SEQ ID NO: 10226 - RNA, 1623 nt, Artificial Sequence; identical to SEQ ID NO: 9499
  derived and/or modified sequence opt1 from VP1__Norovirus__BAU24994

SEQ ID NO: 10227 - RNA, 1623 nt, Artificial Sequence
  derived and/or modified sequence opt1 from VP1__Norovirus__BAU24996
augaagauggccagcuccgacgccaaccccagcgacggcuccgcggccaaccuggugcccgaggucagcaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggguccucacccagaccacccggacggacggcuccacccgcgggcacaaggccaccguguacaccggcagcgccgacuucgccccgaagcugggccgggugcaguucgagacggacaccgaccgcgacuucgaggccaaccagaacaccaaguucacccccgucggggugauccaggacggcuccacgacccaccggaacgagccccagcagugggugcugcccagcuacuccgggcgcaacaccccgaacguccaccucgcccccgcgguggcccccaccuuccccggcgagcagcugcuguucuuccggagcacgaugccggggugcuccggcuaccccaacauggaccucgacugccugcugccccaggagugggugcaguacuucuaccaggaggccgcccccgcgcagagcgacgucgcccuccugcgcuucgugaacccggacaccggccgggugcuguucgagugcaagcuccacaaguccggguacgucaccguggcccacaccggccagcacgaccuggugaucccgcccaacggguacuuccgcuucgacagcugggucaaccaguucuacacccuggcccccaugggcaacgggacgggccgccggcgcgcccucuga

SEQ ID NO: 10228 - RNA, 1623 nt, Artificial Sequence; identical to SEQ ID NO: 9493
  derived and/or modified sequence opt1 from VP1__Norovirus__BAU24998

SEQ ID NO: 10229 - RNA, 1623 nt, Artificial Sequence
  derived and/or modified sequence opt1 from VP1__Norovirus__BAU25002
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccaucccccuggagaagcuguucaccggccccagcuccgccuucgucgugcagccgcagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgaccccaccgaggagaucccggcgccccuggggacgcccgacuucgugggcaagauccaggggguccucacccagaccacccggacggacggcuccacccgcgggcacaaggccaccguguacaccggcagcgccgacuucgcccccaagcugggccgggugcaguucgagacggacaccgaccacgacuucgaggccaaccagaacaccaaguucaccccggucggggugauccaggacggcuccacgacccaccgcaacgagccccagcagugggugcugcccagcuacuccgggcggaacacccccaacguccaccucgccccggcgguggcccccaccuuccccggcgagcagcugcuguucuuccgcagcacgaugcccgggugcuccggcuacccgaacauggaccucgacugccugcugccccaggagugggugcaguacuucuaccaggaggccgcccccgcgcagagcgacgucgcccuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacccuggcccccaugggcaacgggacgggccgccgccgggcccucuga

SEQ ID NO: 10230 - RNA, 1623 nt, Artificial Sequence; identical to SEQ ID NO: 9445
  derived and/or modified sequence opt1 from VP1__Norovirus__BAU25004

SEQ ID NO: 10231 - RNA, 1644 nt, Artificial Sequence
  derived and/or modified sequence opt1 from VP1_protein__Norovirus__ADN84676
augaagauggccagcuccgacgccgcgcccagcaccgacggcuccgccgggcuggugccggaggucaacaacgagaccauggcccucgagcccguggugggcgcgccccuggccgcccccgucgccgggcagcacaacaucaucgacccguggaucaagaugaacuucgugcaggcccccaacggcgaguucacggugagcccccgcaacgcccccggggagauccugcucgaccuggagcugggcccggaccucaaccccuaccugucccaccuggcgcggauguacaacggcuacgccgggggcauggagguccagguggugcucgccgggaacgccuucaccgccggcaagaucaucuucgcggccgucccgcccaacuuccccgccgagaaccugagcgccgcccaggugaccaugugcccccacgugaucgucgacgugcgccagcuggagcccgugaugcuccccaugccggacauccggaacaagcuguuccacuacaaccaggucgacgaccccaagcugcgccuccuggcguaccuguacacgccccuccgggccaacaacgccggggacgacguguucaccguguccugccgcguccugacccggcccaccccggacuucgaguucauguuccuggugccgcccaccguggagagcaagacgaagcccuucucccuccccaaccugacccuggacgagcucagcaacucccgcuuccccgcccccaucguccagcuguacaccaacccccacgacaaccugguggugcagccgcagaacggccggugcaccaucgacggccuccugcaggggacgacccagcuggucagcugcaacgugugcuccuuccgcggcaccaugggggagggccagcccgccagccacuccgaggacgagaucaugcccauggcgaucaacguccagcgggagaucaugcucgagaaccuggacggcagcccguacgaccccaccgacgacauccccgccgugcuggggucccccgacuuccagggcgugauguucgggauccucagccagcgcaacacggacggccagacccgggcccacgaggccaaggucgacacccgcgccgcgcgguucgccccgaagcugggguucgugguggccaccgucgaguccacggacuuccacgccaaccagcccagccgcuucacccccgugggccugggcggggacgcgaaccgggacuucaaccaguggcagcuccccgccuacggcggggcccugaccaacaacaccaaccuggccccgcccgugaugcccgucuaccccggcgagcagcuccuguucuuccgcagccagcugccguccagcgggggcgugguggccggcuggcucgacugccugcugccccaggaguggguccagcacuucuuccaggaguccgcgacgagccaguccaacguggcccucgugcgguacgucaaccccaccaccgggcgcgugcuguucgaggccaagcugcacaagcagggcuuccucaccguggccgccagcggguccuacccccuggucgugccggcggacggcuacuuccgguucgagagcugggugaacgaguucuacacgcuggcccccauggggaacggcuccggccgccgccgggcccgcuga

SEQ ID NO: 10232 - RNA, 1623 nt, Artificial Sequence
  derived and/or modified sequence opt1 from VP1_protein__Norovirus__BAK68870
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacggguccaccacccaccgcaacgagccccagcagugggugcuccccagcuacuccggccggaacguccacaacgugcaccuggccccggccguggcgcccaccuuccccggggagcagcuccucuucuuccgcagcacgaugcccggcugcuccggcuacccgaacauggaccuggacugccugcucccccaggaguggguccagcacuucuaccaggaggccgcccccgcccagagcgacguggcgcugcugcgguucgugaaccccgacaccgggcgcguccucuucgagugcaagcugcacaaguccggcuacgugaccguggcccacaccgggcagcacgaccuggucaucccgcccaacggcuacuuccgguucgacagcugggugaaccaguucuacacccucgcccccauggggaacggcacgggccgccggcgcgcccuguga

SEQ ID NO: 10233 - RNA, 1620 nt, Artificial Sequence
  derived and/or modified sequence opt1 from capsid__Norovirus__AAC54893
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucaccgccggcaaggugaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagccacgacuccacccugaagcucaucgccaugcuguacacgccccugcgggccaacaacgcgggcgacgacguguucaccgugagcugccgcguccucacccggcccuccccggacuucgacuucaucuuccuggugccgcccaccguggagagccgcaccaagcccuucacgguccccauccugaccguggaggagauguccaacagccgguuccccaucccccucgagaagcuguacaccggccccuccagcgccuucgugguccagccgcagaacgggcgcugcaccacggacggcgugcugcucgggaccacccagcuguccgccgucaacaucugcaacuuccggggcgacgugacccacaucgugggcagccacgacuacacgaugaaccuggccagccagaacugguccaacuacgaccccaccgaggagauccccgccccgcucgggacccccgacuucgucggcaagauccaggggcugcugacccagacgacccgcgcggacggcagcacccgggcccacaaggccaccguguccacggggagcgugcacuucacccccaagcucggcuccguccaguucaccaccgacacgaacaacgacuuccagaccggccagaacaccaaguucacccccgugggggugauccaggacggcgaccaccaccagaacgagccgcagcaguggguccugcccaacuacagcgggcgcacgggccacaacgugcaccuggcccccgccguggcgcccaccuucccgggggagcagcuccuguucuuccgguccaccaugcccggcugcagcggcuaccccaacaugaaccuggacugccuccugccccaggaguggguccugcacuucuaccaggaggccgccccggcccaguccgacguggcgcuccugcgcuucgugaaccccgacaccgggcggguccuguucgagugcaagcuccacaagagcggcuacaucacgguggcccacaccgggcccuucgaccuggugaucccgcccaacggcuacuuccgcuucgacuccugggucaaccaguucuacacccuggcccccauggggaacggcaccggccggcgccgggcccucuga

SEQ ID NO: 10234 - RNA, 1647 nt, Artificial Sequence
  derived and/or modified sequence opt1 from capsid__Norovirus__AAW30195
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggagcugacggugagcccccgcaacucccccggcgagguccuccugaaccuggagcucggccccgagaucaacccguaccuggcccaccuggcccggauguacaacggguacgccggcggguucgagguccaggugguccucgccggcaacgcguucaccgccgggaagaucaucuucgccgccaucccgcccaacuuccccaucgacaaccugagcgccgcgcagaucaccaugugcccccacgugaucguggacguccgccagcuggagcccgugaaccuccccaugcccgacgugcggaacaacuucuuccacuacaaccagggcuccgacacccgccugcggcugaucgccaugcucuacacgccgcugcgcgccaacagcuccggcgacgacgucuucaccgugagcugccgggugcugacccgccccucccccgacuucagcuucaacuuccucgugcccccgaccguggaguccaagacgaagcccuucacccugcccauccugaccaucagcgagauguccaacagccgguuccccgugccgaucgacucccuccacaccagccccacggagaacaucgucgugcagugccagaacgggcgcgugacccuggacggcgagcugauggggaccacccagcuccugcccucccagaucugcgccuuccggggcaugcugacgcgcagcaccucccgggccagcgaccaggcggacaccgccgcgccccgccucuucaacuaccacuggcacauccagcuggacaaccugaacggcaccccguacgaccccgccgaggacauccccgggccgcucggcacgcccgacuuccgggggaaggucuucggcguggccagccagcgcaaccccgacuccaccacccgggcccacgaggccaagguggacaccacggccgggcgcuucacccccaagcugggcagccuggagaucuccaccgagagcggcgaccucgaccagaaccagccgaccaaguucacgcccgucgggaucggcguggaccacgaggaggacuuccagcaguggucccugcccgacuacagcgggcaguucacccacaacaugaaccuggcccccgcggucgccccgaacuuccccggcgagcagcuccuguucuuccggucccagcugcccagcuccgggggccgcagcaacggcauccucgacugccuggugccccaggagugggugcagcacuucuaccaggaguccgccccggcccagacccaggucgcccuggugcgguacgugaaccccgacaccgggcgcguccucuucgaggcgaagcugcacaagcugggcuucaugacgaucgccaagaacggggacagccccaucaccgugcccccgaacggcuacuucggguucgaguccugggugaaccccuucuacacccucgcccccaugggcaccggcaacgggcgccggcgcauccaguga

SEQ ID NO: 10235 - RNA, 1647 nt, Artificial Sequence
  derived and/or modified sequence opt1 from capsid__Norovirus__ABD36491
augaagauggccagcaacgacgccgcgcccuccaacgacggcgccgccgggcuggugccggagaucaacaacgaggccauggcccucgagcccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaaggugaucuucgccgccaucccgcccaacuuccccaucgacaaccucagcgcggcccagaucaccaugugcccccacgugaucgucgacgugcgccagcuggagcccaucaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucacccuccccauccugacgaucagcgagauguccaacagccgguuccccgugccgaucgacucccugcacaccagccccaccgagaacaucgucgugcagugccagaacgggcgcgugacccucgacggcgagcugauggggacgacccagcugcuccccucccagaucugcgccuuccggggcacccugacccgcagcacgucccgggcgagcgaccaggccgacaccgccacgccccgccuguucaacuacuacuggcacauccagcucgacaaccugaacggcaccccguacgaccccgccgaggacauccccgccccgcuggggacccccgacuuccggggcaaggucuucgggguggcgagccagcgcaaccccgacuccaccacccgggcccacgaggccaagguggacaccacgagcggccgcuucgcccccaagcucgggucccuggagaucagcaccgaguccagcgacuucgacuccaaccagccgacccgguucacccccgucggcaucggcguggacaacgaggcggacuuccagcaguggagccugcccgacuacuccgggcaguucacgcacaacaugaaccucgcccccgccgucgccccgaacuuccccggcgagcagcugcuguucuuccgcagccagcuccccuccagcgggggccgguccaacgggauccuggacugccuggugccccaggagugggugcagcacuucuaccaggagagcgccccggcgcagacccaggucgcccucgugcgcuacgugaaccccgacaccggccgcguccuguucgaggccaagcugcacaagcucggcuucaugaccaucgccaagaacggggacucccccaucacggugcccccgaacggcuacuuccgguucgagagcugggugaaccccuucuacacccuggcccccauggggaccggcaacgggcgccggcgcauccaguga

SEQ ID NO: 10236 - RNA, 1629 nt, Artificial Sequence
  derived and/or modified sequence opt1 from capsid__Norovirus__ABD36494
augaagauggccagcaacgacgccgcgcccuccaacgacggcgccgccagccuggugccggaggggaucaacgagaccaugccccucgagcccgucgccggcgccuccaucgcggcccccguggccgggcagaccaacaucaucgacccguggauccgcacgaacuucgugcaggcccccaacggcgaguucaccgucagcccccggaacucccccggggagauccugcugaaccucgagcugggcccggaccugaaccccuaccucgcgcaccugagccgcauguacaacggcuacgccgggggcguggaggugcagguccugcucgccgggaacgccuucaccgccggcaagauccuguucgcggccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggguccggcgacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcccccaacgagaacaacgucgugcagugccagaacggccggugcacccucgacggggagcugcagggcaccacgcagcugcucuccagcgcgaucugcuccuaccgcgggcggaccguggccaacaacggcgacaacugggaccagaaccugcugcagcucaccuaccccaacggcgccagcuacgacccgaccgacgagguccccgcgccccuggggacgcaggacuucuccggcaugcuguacggggugcucacccaggacaacaccaacgugagcgccggcgaggccaagaacgccaaggggaucuacaucagcaccacguccggcaaguucacccccaagaucggcagcaucgggcugcacuccaucaccgagcacgucuacccgaaccagcagagccgcuucacccccgugggcgucgccgugaacgagaacacgcccuuccagcagugggugcugccccacuacgccgggucccucgcccugaacaccaaccuggcgccggccgucgcccccaccuuccccggcgagcagcuccuguucuuccggagccgcgugcccugcgugcaggggcagcagggccaggacgucuucaucgacugccugcucccgcaggagugggugaaccacuucuaccaggaggccgcgcccucccaggccgacguggcccugauccgguacgucaaccccgacaccggccgcacgcuguucgaggccaagcuccaccggagcggguucaucaccgugucccacaccggcgccuacccccugguggucccgcccaacgggcacuuccgcuucgacagcugggugaaccaguucuacucccuggcgcccaugggcaccgggaacggccggcgccgcauccaguga

SEQ ID NO: 10237 - RNA, 1614 nt, Artificial Sequence
  derived and/or modified sequence opt1 from capsid__Norovirus__ABD36497
augaagauggccagcaacgacgccgcgcccuccagcgacggcgccgccgggcuggugccggagaucaaccacgaggucauggccaucgagcccguggccggcgcguccaucgccgcccccguggucgggcagcagaacaucaucgaccccuggauccgcaacaacuucgugcaggccccggcgggcgaguucaccgugagcccccggaacgcccccggggaguuccuccuggaccuggagcucggccccgaccugaacccguaccuggcccaccucgcccgcauguacaacggccacgccgggggcauggagguccagaucgugcuggcggggaacgccuucaccgccggcaagauccuguucgccgugaucccgcccggguuccccuacgagaaccucucccccgcccagcugacgaugugcccccacgucgugguggacguccggcagcuggagcccgugaugcuccccaugccggacauccgcaacaccuucuuccacuacaaccaggacggcggcccccggcugcgccugaucgcgaugcucuacacgccccugcgggccaacaacagcggggacgacguguucaccgucuccugccgcgugcugacccggcccgccccggacuucgaguucaccuuccucgugccgcccagcgucgaguccaagaccaaggccuucaccauccccgugcugaagaucagcgagaugacgaacucccgcuuccccgugcccgucgaccagauguacaccagccgguccgagggcaucguggugcagccccagaacgggcgcgccaccaucgacggcgagcugcucggcaccacgcuggucagccccguguccgucugcaacuucaaggggaaccugcagaccgaggugccgggccagcaccagcaguaccagcuccagcugaccaaccuggacgggagccccaucgaccccaccgacgacacgccgggcccccucgggugccccgacuucaucggccugcuguacggcguggcgucccagcgggggcccggcgacgccacccgcgcccacgaggcccggaucgacaccgggagcgacaccuacgccccgaagaucggccagguccgcuucuacuccacgagcaacaacuucgagaccaaccagcccacccacuucacccccguggggguguacaucgagggcagcuccagcgacuucaaccaguggcagcucccccgguacggcgggcaccuggcgaacaacaaccaccuggccccggccgucagcccccucuuccccggcgagcagauccuguucuuccgcuccuucauccccggggccuccggccacacgaacggggagauggacugccugcucccgcaggaguucgugcagcacuucuaccaggaggcggccaccgcccagagcgagguggcccugcugcgguucgucaaccccgacaccggccgcguccucuucgaguccaagcugcacaagcagggcuucaugaccaucgccagcuccggggaccaccccaucaucaugcccacgaacggcuacuuccgguucgaggcgugggugaaccaguucuacagccuggccccgguggggaccggcuccggccgccgccggauccaguga

SEQ ID NO: 10238 - RNA, 1623 nt, Artificial Sequence
  derived and/or modified sequence opt1 from capsid__Norovirus__ABL74387
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcgugcacuucaccccgaagcugggcagcguccaguucuccaccgacaccagcaacgacuucgaggccgggcagaacacgcgguucacccccgugggcgugguccaggacggguccaccacccaccagaacgagccccagcagugggugcugcccgacuacagcggccgcgacucccacaacgugcaccucgccccggccgucgcccccacguuccccggggagcagcugcuguucuuccggagcaccaugcccggcugcuccggcuacccgaacaugaaccucgacugccugcugccccaggagugggugcagcacuucuaccaggagagcgcgcccgcccaguccgacguggcccuccugcgcuucgucaaccccgacaccgggcgggugcuguucgagugcaagcuccacaagagcggcuacgugaccgucgccuacaccgggcagcacgaccuggugaucccgcccaacggcuacuuccgcuucgacuccugggugaaccaguucuacacgcuggcgcccauggggaacggcgccggccggcgccgcgcccucuga

SEQ ID NO: 10239 - RNA, 1623 nt, Artificial Sequence
  derived and/or modified sequence opt1 from capsid__Norovirus__ABL74389
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgauccggcugaucgccaugcucuacacgccccugcgcgccaacaacgcgggcgacgacguguucaccguguccugccggguccugacccgcccgagccccgacuucgacuucaucuuccucgugccgcccaccguggagucccggaccaagcccuucagcguccccauccugaccguggaggagaugaccaacucccgcuuccccaucccccuggagaagcuguucacgggcccgagcuccgccuucgugguccagccccagaacgggcggugcaccaccgacggcgugcuccuggggaccacgcagcucagccccgucaacaucugcaccuuccgcggcgacgugacccacaucgccggcacccagaacuacacgaugaaccuggccucccagaacuggaacaacuacgacccgaccgaggaggugcccgcgccccuggggacccccgacuucgucggcaagauccagggggugcucacccagacgacccggggcgacgggagcacccgcggccacaaggccaccguguccacgggcagcguccacuucaccccgaagcuggggagcgugcaguucuccaccgacaccagcaacgacuucgagacgggccagaacacccgguucacccccgugggggucgugcaggacggcuccaccacgcaccagaacgagccccagcagugggugcugcccgacuacagcgggcgcgacaaccacaacguccaccucgccccggccguggcccccaccuuccccggcgagcagcugcuguucuuccgguccaccaugcccggcugcagcggguacccgaacaugaaccucgacugccugcugccccaggagugggugcagcacuucuaccaggaguccgcccccgcgcagagcgacgucgcccuccugcgcuucgugaaccccgacaccggccgggugcuguucgagugcaagcuccacaaguccggguacgucaccguggcccacacgggccagcacgaccuggugaucccgcccaacggguacuuccgcuucgacagcugggucaaccaguucuacacccuggcccccaugggcaacggcgcggggcggcgccgcgcccucuga

SEQ ID NO: 10240 - RNA, 1623 nt, Artificial Sequence; identical to SEQ ID NO: 9292
  derived and/or modified sequence opt1 from capsid__Norovirus__ABL74397

SEQ ID NO: 10241 - RNA, 1593 nt, Artificial Sequence
  derived and/or modified sequence opt1 from capsid__Norovirus__ABQ44562
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcggcauggggaucuccccggacaacguccagagcgugcaguuccagaacggccgcugcacccucgacgggcggcuggugggcacgacccccgucagccugucccacguggccaagauccgcgggaccagcaacggcaccgucaucaaccucacggagcuggacggcacccccuuccaccccuucgaggggccggcccccaucggcuuccccgaccucgggggcugcgacuggcacaucaacaugacccaguucgggcacuccagccagacccaguacgacguggacacgaccccggacaccuucgugccccaccucggcuccauccaggccaacggcgucagcuccgggaacuacaucggcgugcugagcuggguguccccgcccagccaccccuccgggagccaggucgaccuguggaagauccccaacuacggcuccagcaucaccgaggccacgcaccucgcccccuccguguacccgcccggguucggcgaggugcuggucuucuucaugagcaagauccccggccccggggccuacucccugcccugccuccugccgcaggaguacaucagccaccuggccuccgagcaggcgcccaccgugggcgaggccgcccuccugcacuacguggaccccgacaccgggcggaaccugggcgaguucaaggccuaccccgacggcuuccugaccugcgucccgaacggggccagcagcggcccccagcagcugcccaucaacgggguguucguguucgucuccugggugagccgcuucuaccagcugaagcccgugggcacggcguccaccgcccgggggcgccucggccugcggcgcuga

SEQ ID NO: 10242 - RNA, 1638 nt, Artificial Sequence
  derived and/or modified sequence opt1 from capsid__Norovirus__ABQ44563
augaugauggccagcaagggcgcccccaccaacauggacgggaccuccggcgcggggcagcuggugccggaggccaacacggccgagcccaucagcauggagcccgucgccggcgccgcgaccgccgccgccaccgcgggccaggugaacaugaucgaccccuggaucaugaacaacuacgugcaggccccgcagggggaguucaccaucucccccaacaacacgcccggcgacauccucuucgaccugcagcuggggccccaccucaacccguuccugagccaccuggcccagauguacaacggcugggucgggaacaugaaggugaaggugcuccuggccggcaacgccuucaccgcggggaagaucaucaucuccugcaucccgcccggcuucgucgcccagaacaucagcaucgcccaggccaccauguucccccacgugaucgccgacgugcgcguccuggagcccaucgaggugccccucgaggacgugcggaacguccuguuccacaacaacgacaacacccccacgaugcgccuggugugcaugcucuacacgccccugcgggcguccggcagcuccagcgggaccgacccguucgugaucgccggccgcguccugaccugccccucccccgacuucagcuuccucuuccuggugcccccgaacguggagcagaagaccaagcccuucuccguccccaaccugccccucaacacccugagcaacucccgggugccgagccugaucaaguccaugauggugagccgcgaccacgggcagaugguccaguuccagaacggccgggugacccucgacggccagcugcaggggaccacgcccaccuccgccagccagcugugcaagauccgcggcagcguguuccacgccaacgggggcaacggguacaaccucaccgagcuggacggcucccccuaccacgccuucgagagccccgcgccgaucggcuuccccgaccugggggagugcgacuggcacauggaggccucccccaccacgcaguucaacaccggcgacgucaucaagcagaucaacgugaagcaggagagcgccuucgccccgcaccucgggaccauccaggccgacggccuguccgacgucagcgugaacaccaacaugaucgcgaagcuggagugggugucccccgucagcgacgggcacaagggcgacguggaccccugggugaucccccgguacggcuccacgcucaccgaggccgcccagcuggccccgcccaucuacccgcccggguucggcgaggcgaucgucuucuucaugagcgacuuccccaucgcccacgggaccaacggccuguccgugcccugcaccaucccccaggaguucgugacgcacuucgucaacgagcaggcccccacccgcggggaggccgcccuccugcacuaccuggacccggacacccaccggaaccucggcgaguucaagcuguaccccgacggcuucaugaccugcgugcccaacagcuccgggacgggcccccagacccugccgaucaacgggguguucgucuucgugagcugggugucccgcuucuaccagcucaagcccgucggcaccgcgggccccgcccggcgccuggggauccggcgcagcuga

SEQ ID NO: 10243 - RNA, 1635 nt, Artificial Sequence
  derived and/or modified sequence opt1 from capsid__Norovirus__ABQ44564
augaugauggccagcaaggacgccacccccuccgcggacggcgccaccggggccggccagcuggugccggaggucaacacggccgaccccauccccaucgaccccguggccgggagcuccaccgcgcucgccaccgccggccaggugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcgcguccggguggugcuggccgggaacgccuucaccgccggcaaggucaucaucugcugcgugccgcccggguuccagucccgcacccucagcaucgcccaggccacccuguucccccacgugaucgcggacguccggacgcuggaccccguggaggugccccucgaggacguccgcaacgugcuguaccacaacaacgacacccagcccaccaugcggcugcucugcaugcuguacaccccgcugcgcacgggcggcgccuccgggggcaccgacagcuucguggucgccgggcgggugcugaccugccccggccccgacuucaacuuccucuuccuggugcccccgaccgucgagcagaagacgcgccccuucaccgugcccaacaucccccucaaguaccuguccaacagccggaucccgaaccccaucgagggcaugucccugagccccgaccagacccagaacgugcaguuccagaacgggcgcugcaccaucgacggccagccccucgggacgaccccggucuccgugagccagcugugcaaguuccggggccgcaucaccuccgggcagaagguccugaaccucaccgagcuggacggcagccccuucauggccuucgccgcgcccgccccggccggcuuccccgaccugggguccugcgacuggcacaucgaggugagcaagauccccaacagcuccacgcagagcaaccccaucguggucaacuccgugaagccgaacagccagcaguucgugccccaccucuccagcaucacccuggacgacaacgucuccagcggcggggacuacaucggcaccauccaguggaccuccccgcccagcgacuccgggggcgccaacacgaacuucuggaagauccccgacuacggcagcucccuggccgaggcgagccagcucgcccccgccguguacccgcccggguucaacgaggugaucgucuacuucauggccuccauccccggccccaaccagagcgggucccccaaccuggugcccugccugcucccgcaggaguacaucacccacuucaucagcgagcaggcccccauccagggcgaggcggcccugcugcacuacguggaccccgacaccaaccggaaccucggggaguucaagcuguaccccggcggcuaccugaccugcgucccgaacuccagcagcacggggccccagcagcucccccuggacggcguguucguguucgccuccugggucagccgcuucuaccagcugaagcccguggggaccgccggcccggcgcggggccgccucggggugcggcgcuga

SEQ ID NO: 10244 - RNA, 1623 nt, Artificial Sequence
  derived and/or modified sequence opt1 from capsid__Norovirus__ABQ44565
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguuccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacgugccccucaaggaccuguccaacagccgggugcccgucccgauccagggcauguucaugucccccgacgugaaccagagcgugcaguuccagaacgggcgcugccagaucgacggccagcugcaggggaccacccccgucucccucagccagcugugcaagauccggggcaagacguccagcaacgcccgcgugcugaaccucagcgaggucgacgggucccccuucaucccgcuggagagccccgcccccgugggcuucccggaccugggcgggugcgacuggcacgugaacuucaccuuccaggcgcaggaccaggaccccucccagagcgucaccuucgccaccaacgacgccuccuucgugcccuaccucggcagcaucagcccccacaacgggggcgacuuccacuccggggacaucaucggcucccugggcuggaucagcgccccguccgacagcucccagcugaacguguggacgauccccaaguacgggagcucccuccccgacgucacccaccuggcccccgcgguguucccgcccggcuucggggaggugauccuguacuucuacagcaccuuccccggcuccgggcagcccggccagcuccaggucccgugccugcugccccaggaguucaucacccacuucugcaacgagcaggcccccaucgccggcgaggccgcgcuccugcacuacguggaccccgacacggggcggaaccugggcgaguucaagcucuacccggacggguucaugaccugcgugcccaacagcgucuccagcggcccccagacccugcccaucaacggcguguucguguucgucagcugggugucccgcuucuaccagcugaagccgguggggaccgccagcgucgcccggcgccucggccugcggcgcaucuga

SEQ ID NO: 10245 - RNA, 1635 nt, Artificial Sequence
  derived and/or modified sequence opt1 from capsid__Norovirus__ABQ44566
augaugauggccagcaaggacgcccccaccaacauggacggcaccuccggggcgggccagcuggugccggaggccaacacggccgagcccaucagcauggaccccgucgccggggccgcgaccgccguggccaccgccggccagaucaacaugaucgaccccuggaucauguccaacuucgugcaggcgccgcagggggaguucaccgucagccccaacaacacgcccggcgacguccucuucgaccugcagcugggcccccagcucaacccguuccuggcccaccuggcccagauguacaacgggugggugggcaacaugcgcgugaaggugcuccuggccgggaacgccuucaccgcgggcaagaucaucaucuccugcaucccgcccggguucaccagccagaacaucuccaucgcccagaugaccauguucccccacgugaucgccgacguccgggugcuggagcccaucgaggugccccucgaggacguccgcaacgugcuguuccacacgaacgacaaccggcccaccaugcgccuggugugcaugcucuacacgccccugcgggccaacggcagcuccagcggcaccgacccguucgucaucgccgggcgcgugcugaccugccccgacuccaacuucagcuuccucuuccuggugccgcccaacgucgagcagaagacccggcccuucuccgugcccaacaucccccugaacacccucagcaacucccgcgugcccagccugaucaaguccaugaccaucagccgggaccagaaccagaucauccaguuccagaacggccgcgucacgcuggacgggcagcuccagggcaccaccccgaccuccgugagccagcugugcaagauccggggcacgaccuaccacgcgaccgggggcaacgggaucaaccugaccgagcucaacggcgagcccuaccacgccuucgagagccccgcccccaucggguucccggaccugggcggcugcgacuggcaccugacggccacccccacccaggccuucaacgacggggcgaaggugguccgccucuccgugacccagggcgccgccuucgcgccccaccuggggacgauccacuacaccaccaccgacacggacuacagcccgaacaccuccaucaucugcacccuggacuggcucagccagaccacgggccaguccaacgucgaccccuggcagauccccaccuacgggagcacccugaccgaggccgcccagcuggcgcccccgaucuucccgcccggcuucggcgagacccucguguucuuccuguccgacuuccccaucagcaacgggaagaacggccuguccgugcccugcacgcucccccaggaguucgucacccacuucgugaacgagcaggcccccauccgcggggaggccgcccugcugcacuacguggaccccgacacccaccggaaccucggcgaguucaagcuguacccggagggguucaugaccugcguccccaacacgagcggcggcgggccccagacccugcccaucaacggcguguucguguucgucuccugggugagccgguucuaccagcucaagccgguggggaccgccggcgccgcccgccggcugggcauccgccgguccuga

SEQ ID NO: 10246 - RNA, 1608 nt, Artificial Sequence
  derived and/or modified sequence opt1 from capsid__Norovirus__ABQ44567
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgcaugaacuucguccaggccccgaacggcgaguucacggugagcccccggaacucccccggggagauccugcucaaccuggagcugggccccgagcucaacccguuccuggcccaccugucccgcauguacaacggcuacgccgggggcguggagguccaggugcuccuggccgggaacgccuucaccgccggcaagcugguguucgcggccaucccgccccacuuccccaucgagaaccucagccccgggcagaucaccauguucccccacgucaucaucgacgugcggacccuggagcccgugcugcucccccugccggacguccgcaacaacuucuuccacuacaaccaggagcccgagccccggaugcgccugguggccaugcucuacacgccccugcgguccaacggcagcggcgacgacguguucaccgucuccugccgcgugcugacccggccgagccccgacuucgacuucaacuaccucgugccgcccaccgucgaguccaagacgaagcccuucacccugcccauccugaccaucggggagcucagcaacucccgcuuccccgcccccaucgacgagcuguacaccagcccgaacgagggccugguggugcagccccagaacgggcgguccacgcucgacggcgagcugcugggcaccacccagcucguccccagcaacaucugcucccugcgcgggcggaucaacgcccaccucccggacaaccagcaccgcuggaacaugcaggucaccaacgcgaacggcacgcccuucgaccccaccgaggacgugcccgccccgcucgggacccccgacuuccuggccaacaucuacggcgugaccagccagcggaaccccgacaacacgugccgcgcccacgacgggauccuggccaccuggucccccaaguucaccccgaagcucggcagcgugguccugggcaccugggaggaccgggacuucgacaucaaccagcccacgcgcuucacccccguggggcuguacgacaccgaccacuucaaccagugggcgcuccccaacuacagcggcgcccugacccugaacaugaaccucgccccguccguggcgccccuguuccccggggagcagcugcuguucuuccggagccacaucccccugaagggcgggacguccagcggcgccaucgacugccugcucccgcaggaguggguccagcacuucuaccaggaguccgcccccagcuccaccgacguggcccugauccgcuacaccaaccccgacaccggccgggugcuguucgaggccaagcugcaccgccagggguucaucacggucgccaacagcggcucccgccccaucguggugccgcccaacggguacuuccgguucgacagcugggucaaccaguucuacucccucgcgcccaugggcaccgggaacggccgccggcgcgugcaguga

SEQ ID NO: 10247 - RNA, 1629 nt, Artificial Sequence
  derived and/or modified sequence opt1 from capsid__Norovirus__ABQ44568
augaacauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacgggagcggcgacgacguguucaccguguccugccggguccucacccgccccagcccggacuucgacuucaccuaccuggugccgcccaccguggaguccaagaccaagcccuucacccugcccauccucacgcugggcgagcugagcaacucccgguuccccgucagcaucgaccagauguacaccucccccaacgaggugaucagcgugcagugccagaacgggcgcugcacccucgacggcgagcugcaggggaccacgcagcugcaggucuccggcaucugcgccuucaagggcgaggugaccgcccaccuccacgacaacgaccaccuguacaacgucaccaucaccaaccugaacgggagccccuucgacccguccgaggacauccccgcgccccucggcgugccggacuuccaggggcggguguucggcgucaucagccagcgcgacaagcagaacgcggccgggcacaacgagcccgccaaccggggccacgacgccguggugcccacguacaccgcccaguacacccccaagcugggccagauccagaucgggaccuggcagacggacgaccugaccgucaaccagccggugaaguucacccccgugggccucaacgacaccgagcacuucaaccagugggucgugccccgcuacgcgggggcccugaaccugaacacgaaccucgcccccuccguggccccggucuuccccggcgagcggcugcuguucuuccgcagcuacaucccccucaagggcggguacggcaaccccgcgaucgacugccugcugccgcaggagugggugcagcacuucuaccaggaggccgcccccagcauguccgagguggcccucguccgguacaucaaccccgacaccgggcgcgcccuguucgaggcgaagcugcaccgggccggcuucaugaccgugagcuccaacaccagcgcccccguggucgugccggccaacggguacuuccgcuucgacuccugggugaaccaguucuacagccucgcccccaugggcacggggaacggccggcgccgcguccaguga

SEQ ID NO: 10248 - RNA, 1647 nt, Artificial Sequence
  derived and/or modified sequence opt1 from capsid__Norovirus__ABQ44569
augaagauggccagcaacgacgccgcgcccuccaacgacggcgccgccgggcuggugccggagaucaacaacgaggccauggcccucgaccccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguacgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucaccgugagcugccgggugcugacgcgccccucccccgacuucagcuucaacuuccuggugcccccgaccguggaguccaagaccaagcccuucacccuccccauccugacgaucagcgagauguccaacagccgguuccccgugccgaucgacucccugcacaccagccccaccgagaacaucgucgugcagugccagaacgggcgcgugacccucgacggcgagcugauggggacgacccagcugcuccccucccagaucugcgccuuccggggcguccugacccgcagcaccucccgggcgagcgaccaggccgacacggccacgccccgccuguucaacuacuacuggcacauccagcucgacaaccugaacggcaccccguacgaccccgccgaggacauccccgggccgcugggcacccccgacuuccgggggaagguguucggcguggccagccagcgcaaccccgacuccaccacccgggcgcacgaggccaaggucgacaccaccgccgggcgcuucacgcccaagcucggcagccuggagaucuccaccgagagcgacgacuucgaccagaaccagccgacccgguucacccccgugggcaucggggucgaccacgaggccgacuuccagcaguggucccugcccgacuacagcggccaguucacgcacaacaugaaccucgcgcccgccguggccccgaacuuccccggggagcagcugcuguucuuccgcucccagcuccccagcuccggcgggcggagcaacggcauccuggacugccuggugccccaggaguggguccagcacuucuaccaggaguccgccccggcccagacccagguggcgcucgugcgcuacgucaaccccgacaccggccgcgugcuguucgaggccaagcugcacaagcucggguucaugaccaucgccaagaacggcgacagccccaucacggugcccccgaacggguacuuccgguucgaguccugggucaaccccuucuacacccuggcccccaugggcaccgggaacggccgccggcgcauccaguga

SEQ ID NO: 10249 - RNA, 1623 nt, Artificial Sequence
  derived and/or modified sequence opt1 from capsid__Norovirus__ABQ44570
augaagauggccagcaacgacgccgcgcccuccaacgacggcgccgccgggcuggugccggagagcaacaacgaggccauggcccucgagcccgucaugggcgcgucccuggccgcccccgugaccgggcagaccaacaucaucgaccccuggauccgcacgaacuucgugcaggccccgaacggcgaguucaccgucagcccccggaacucccccggggagauccuggugaaccucgagcugggccccgagcugaacccguaccucgcgcaccuggcccgcauguacaacggcuacgccgggggcauggaggugcaggucaugcuggccgggaacgccuucaccgcgggcaagaucaucuucgccgccgugccgcccuacuuccccguggagaaccucagcccgucccagaucaccauguucccccacgucaucaucgacgugcggacgcuggagcccgugcugcuccccaugccggacguccgcagcacccuguuccacuucaaccagaaggacgagcccaagaugcggcugguggccaugcucuacacgccccugcgcuccaacgggagcggcgacgacguguucaccgucuccugccggauccugacccgccccagcccggaguucgacuucaccuaccucgugccgcccaccguggaguccaagaccaagcccuucacgcugcccguccugacccucggcgagcugagcaacucccgguucccccugagcaucgacgagauggugaccucccccaacgagagcaucgugguccagccccagaacgggcgcgugacccucgacggcgagcugcuggggacgacccagcuccaggccugcaacaucugcuccauccggggcaaggugaccggccaggucccgaacgagcagcacauguggaaccuggaggugaccaaccugaacgggacgcaguucgaccccaccgacgacguccccgcgccgcucggcgugcccgacuucgccggggagguguucggcguccugagccagcgcaaccgcggggagagcaaccccgccaaccgggcccacgacgccgugguggcgaccuacuccgacaaguacacccccaagcugggccucguccagaucggcacguggaacaccaacgacguggagaaccagccgaccaaguucacccccaucgggcugaacgagguggccaacggccaccgguucgagcaguggacgcugccccgcuacagcggggcccucacccugaacaugaaccuggcccccgccgucgcgccccucuuccccggcgagcggcugcuguucuuccgcuccuacaucccccucaagggcggguucggcaaccccgccaucgacugccuggugccgcaggagugggugcagcacuucuaccaggagagcgcccccucccugggggacgucgcccucgugcgguacgugaaccccgacaccggccgcguccuguucgaggcgaagcugcacaagggcggguuccucaccgugagcuccacgagcaccgggcccguggucgugccggccaacggcuacuuccgguucgacuccugggugaaccaguucuacagccuggcccccaugggcaccgggaacggccgccgccgguuccaguga

SEQ ID NO: 10250 - RNA, 1653 nt, Artificial Sequence
  derived and/or modified sequence opt1 from capsid__Norovirus__ABQ44571
augaagauggccagcaacgacgccgcgcccuccaacgacggcgccgccaaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggacaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggccgccaucgacaugcuguacaccgaccccaacgaguccaucguggugcagccccagaacggccgcugcacccuggacggcacgcuccaggggaccacccagcugguccccacccagaucugcgccuuccggggcacgcugaucagccagaccgcccgcgcggccgacuccaccgacagcccgcagcgggcccgcgaccacccccuccacgugcaggucaagaaccuggacgggacccaguacgaccccacggacgacaucccggccgugcugggcgccaucgacuucaagggcaccguguucggggucgcgucccagcgggacgugagcggcccccaggagcaggggcacuacgccacccgcgcccacgaggcccacaucgacaccacggaccccaaguacgcgcccaagcucggcaccauccugaucaaguccgagagcaacgacuucaucaccaaccagccgauccgguucacccccguggggaugggcgacaacaacuggcgccagugggagcugcccgacuacagcggccggcucacgcugaacaugaaccuggcccccgccgucuccccgagcuuccccggggagcgcauccucuucuuccgcuccaucgugcccagcgccggcggguacggcuccggguacaucgacugccugaucccccaggagugggugcagcacuucuaccaggaggccgcgccgagccaguccgccgucgcccuggugcgguacgugaaccccgacaccggccgcaacaucuucgaggccaagcuccaccgggagggcuuccugaccgucgccaacagcgggaacaaccccaucguggugcccccgaacggcuacuuccgcuucgaggcgugggucaaccaguucuacacccuggcccccaugggguccggccaggggcggcgccgggcccaguga

SEQ ID NO: 10251 - RNA, 1623 nt, Artificial Sequence
  derived and/or modified sequence opt1 from capsid__Norovirus__ABQ44572
augaagauggccagcaacgacgccgcgcccuccagcgacggcgccgccgggcuggugccggagaucaacaacgaggucaugccccucgaccccguggccggcgccucccuggcgacccccguggucgggcagcagaacaucaucgacccguggauccgcaacaacuucgugcaggcccccgccggcgaguucaccgugagcccccggaacucccccggggagauccugcucgaccuggagcugggcccggagcucaaccccuaccuggcccaccuggcgcgcauguacaacggccacgccgggggcauggagguccagaucgugcucgccgggaacgccuucacggccggcaagaucaucuucgcggccaucccgcccggguuccccuacgagaaccugagccccucccagaucaccaugugcccccacgugaucaucgacguccggcagcuggagcccgugcuccugccgaugcccgacauccgcaacaacuucuuccacuacaaccagggcaacgaccccaagcugcggcucguggccaugcuguacacgccccugcgcgccaacaacagcggcgacgacgucuucaccguguccugccgggugcucaccaagccgagccccgacuucgaguucaccuuccuggucccgcccaccguggaguccaagaccaagcaguucacgcugcccauccucaagaucagcgagaugaccaacucccgcuuccccgugcccgucgacgugauguacaccgcccggaacgagaaccaggugguccagccccagaacgggcgcgugacccuggacggcgagcugcucgggacgaccccgcugcuggcggugaacaucugcaaguucaagggcgaggucaucgccaagaacggcgacgugcggagcuaccgcauggacauggagaucaccaacaccgacgggacgcccaucgaccccaccgaggacaccccgggccccaucgggucccccgacuuccagggcauccucuucggggucgccagccagcggaacaagaacgagcagaaccccgccacccgcgcccacgaggcgaacaucaacacgggcggcgaccaguacgccccgaagcuggcccaggugaaguucuucuccgagagccaggacuucgaggugcaccagcccaccaccuucacccccgucgggguggccggcgacaacucccaccccuuccggcaguggacgcugccgcgcuacgggggccaccucaccaacaacacccaccuggcccccgcgguggcgccccuguuccccggggagcagcuccuguucuuccggagccagaucccgagcuccggcggccacgagagcggguacauggacugccuggucccccaggagugggugcagcacuucuaccaggaggccgccaccgcccaguccgagguggcccucauccgcuucaucaaccccgacacgggccggguccuguucgaggccaagcugcacaagcagggguucaucaccguggcccacaccggcgacaaccccaucgugaugccgcccaacggguacuuccgcuucgaggccugggucaaccaguucuacagccucgcgcccgugggcaccggcaacgggcggcgccgcgugcaguga

SEQ ID NO: 10252 - RNA, 1608 nt, Artificial Sequence
  derived and/or modified sequence opt1 from capsid__Norovirus__ABQ44573
augaagauggccagcaacgacgccgcgcccuccaacgacggcgccgccgggcuggugccggaggccaacaacgagaccauggcccucgagcccgucgcgggcgccagcaucgccgcgccccugaccgggcagaacaacaucaucgaccccuggauccgccugaacuucgugcaggccccgaacggcgaguucacggugagcccccggaacucccccggggagguccuccugaaccuggagcucggccccgagcugaacccguaccuggcccaccucucccgcauguacaacggcuacgccgggggcguggaggugcagguccugcuggccgggaacgccuucaccgcgggcaagcucguguucgccgccgugccgccccacuucccccuggagaacaucagccccgggcagaucaccauguucccccacgucaucaucgacgugcggacccuggagcccgugcuccugccccugccggacguccgcaacaacuucuuccacuacaaccagcagaacgagccccggaugcgccucguggccaugcuguacacgccccugcgguccaacggcagcggcgacgacguguucaccgucuccugccgcgugcucacccggcccagcccggacuucgacuucaacuaccuggugccgcccaccgucgaguccaagacgaagcccuucacccugcccauccucaccaucggggagcugaccaacagccgcuuccccgugcccaucgacgagcuguacacgucccccaacgagagccucgugguccagccgcagaacggccggugcgcccuggacggggagcugcagggcaccacccagcuccugcccaccgcgaucugcuccuuccgcggccggaucaaccagaaggugagcggggagaaccacguguggaacaugcaggucacgaacaucaacggcacccccuucgacccgaccgaggacgugcccgucccccuggggacccccgacuucuccggcaagcuguucggggugcucagccagcgcgaccacgacaacgccugccggucccacgacgccgugaucgccacgaacagcgccaaguucaccccgaagcugggcgcgauccagaucggcaccugggaggagaacgacguccacaucaaccagcccaccaaguucacgcccgugggccucuucgaggacgagggguucaaccaguggacccugcccaacuacagcggggcccugacccucaacgugggccuggccccgcccgucgcccccaccuuccccggggagcagauccuguucuuccgcucccacaucccgcucaagggcggcguggccgaccccgugaucgacugccugcugccccaggaguggauccagcaccucuaccaggagagcgcgcccucccagagcgacgucgcccugauccgguucacgaacccggacaccgggcgcgugcuguucgaggccaagcuccaccgguccggcuacaucaccguggccaacaccgggagccgccccaucgucgugcccgcgaacggcuacuuccgguucgacuccugggugaaccaguucuacagccuggcccccauggggacgggcaacggccgccgccggguccaguga

SEQ ID NO: 10253 - RNA, 1614 nt, Artificial Sequence
  derived and/or modified sequence opt1 from capsid__Norovirus__ABQ44574
augaagauggccagcaacgacgccacccccuccgacgacggcgcggccgggcuggugccggagaucaacaacgaggucauggcccucgagcccguggccggcgccagcaucgcggcccccguggucgggcagcagaacaucaucgaccccuggauccgcaacaacuucgugcaggccccggccggcgaguucaccgugagcccccggaacucccccggggagcugcugcucgaccuggagcugggccccgagcucaacccguaccuggcgcaccuggcccgcauguacaacggccacgccgggggcauggagguccagaucgugcucgccgggaacgccuucacggcgggcaagauccuguucgccgccaucccgcccuccuuccccuacgagaaccugagccccgcccagcucaccaugugcccccacgugaucgucgacgugcggcagcuggagcccgugcugcuccccaugccggacauccgcaacgucuucuaccacuacaaccagaacaacucccccaagcugcggcugguggccaugcucuacacgccccugcgcgcgaacaacagcggggacgacguguucaccgucuccugccgggugcugacccgccccagcccggacuuccaguucaccuuccucgugccgcccaccgucgaguccaagaccaagaacuucacgcugcccgugcugcgggugagcgagaugaccaacucccgcgucccccggugcuucggcaccaagugcauccaggcccgcaacgagaacaucaucgugcagccccagaacggccggugcaccacggacggggagcuccugggcaccaccacccugcagagcguguccaucugcaacuuccgcgggacgaugcaggccaagcucaacgagcagccccgguaccagcugcagcugaccaaccucgacggcagccccaucgacccgaccgacgacaugcccgcgccccugggcaccccggacuuccaggccaugcuguacggggucgccucccagcgcagcucccgggacaacgccacgcgcgcccacgacgcccagaucgacaccgccggcgacaccuucgcgcccaagaucggccaggugcgguucaagagcagcuccggggacuucgaccuccacgaccccaccaaguucacgcccaucggggucaacguggacgaccagcacccguuccgccaguggagccugcccaacuacggcggccaccuggcccucaacaaccaccuggcccccgccgugacgccccuguucccgggggagcagauccucuucuuccggucccacauccccagcgcgggcgggcacaccgacggcgccauggacugccugcugccccaggaguggaucgagcacuucuaccaggaggccgcccccucccagagcgacaucgcccucguccgcuucaucaacccggacaccgggcgcgugcugcuggaggcgaagcuccacaagcagggcuuccugaccguggccgccuccggcgaccaccccaucgucaugcccaccaacggguacuuccgguucgaggccugggugaaccccuucuacacccuggccccggugggcaccgggagcggccgccggcgcauccaguga

SEQ ID NO: 10254 - RNA, 1641 nt, Artificial Sequence
  derived and/or modified sequence opt1 from capsid__Norovirus__ABQ44575
augaagauggccagcaacgacgccgcgcccuccaacgacggcgccgccagccuggugccggaggggaucaacgagaccaugccccucgagcccgucgccggcgccuccaucgcggcccccguggccgggcagaccaacaucaucgacccguggauccgcacgaacuucgugcaggcccccaacggcgaguucaccgucagcccccggaacucccccggggagauccugcugaaccucgagcugggcccggaccugaaccccuaccucgcgcaccugagccgcauguacaacggcuacgccgggggcguggaggugcagguccugcucgccgggaacgccuucaccgccggcaagauccuguucgcggccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggguccggcgacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcccccaacgagaccaacgucgugcagugccagaacggccggugcacccucgacggggagcugcagggcacgacccagcugcucuccagcgcggugugcuccuaccgcgggcggaccgucgccaacaacggcgacaacugggaccagaaccugcugcagcucaccuaccccaacggcgccagcuacgacccgacggacgaggugcccgcgccccuggggacccaggacuucuccggcaugcuguacggggugcucacccaggacaacgucaacgugagcaccggcgaggccaagaacgccaaggggaucuacaucagcacgaccuccggcaaguucacccccaagaucggcagcaucgggcugcacuccaucaccgagcacguccacccgaaccagcagagccgcuucacgcccgugggcguggccgucaacgagaacacccccuuccagcagugggugcugccccacuacgccgggucccucgcccugaacaccaaccuggccccggcgguggcccccaccuuccccggcgagcagcuccuguucuuccggagccgcguccccugcgugcaggggcugcagggccaggacgccuucaucgacugccuccugccgcaggagugggugaaccacuucuaccaggaggccgcgcccgcccccgcccccucccaggccgacgucgcccugauccgguacgugaacccggacacgggccgcacccucuucgaggcgaagcugcaccggagcggguucaucaccgugucccacaccggcgccuacccccuggucgugccgcccaacgggcacuuccgcuucgacagcugggugaaccaguucuacucccucgcccccaugggcacggggaacggccggcgccgcauccaguga

SEQ ID NO: 10255 - RNA, 1623 nt, Artificial Sequence
  derived and/or modified sequence opt1 from capsid__Norovirus__ABQ44576
augaagauggccagcaacgacgccgcgcccuccaacgacggcgccgccgggcuggugcccgaggucaacaacgagacccucgcccuggagcccguggccggcgcgagcaucgccgcgccccugaccgggcagaacaacgugaucgaccccuggauccgccucaacuucguccaggccccgaacggcgaguucacggugagcccccggaacucccccggggagauccugcugaaccucgagcugggccccgagcugaacccguaccucgcccaccuggcccgcauguacaacggcuacgccgggggcguggagguccaggugcugcucgccgggaacgccuucaccgcgggcaagcugguguucgccgccaucccgccccacuuccccgucgacaaccugucccccgggcagaucaccauguucccccacgugaucaucgacgugcggacccucgagcccguccugcugccccucccggacgugcgcaacagcuucuuccacuacaaccagcaguccgaccagcggaugcgccugaucgccaugcuguacacgccccuccggagcaacggcuccggcgacgacguguucaccgucagcugccgcgugcugacccggcccucccccgacuucgacuucaacuaccuggugccgcccaccgucgagagcaagacgaagcccuucuccgugcccgugcucacccugaacgagcugaccaacagccgcuucccgguccccaucgacgccauguacaccucccccaacgacagcaucguggugcagccccagaacgggcgggcgacgaucgacggcgagcuccuggggaccacccagcugaucccguccggcaucugcagcuuccgcggcaagaucaccacgcaccucuccgacgaccggcaccuguggaacauccaggucaccaaccugaacgggacccccuucgaccccaccgacgacgugccggcgccccucggcaugcccgacuucagcgggcagaucuucggcgucgugagccagcgcgacacggggaccaaccccgccaaccgggcccacgacgccgugcuggccaccuacuccgccaaguacaccccgaagcugggcagcguccagaucggcacgugggacaccgaggaccuccuggagcgccagcccgugaaguucacccccguggggcugaacgagaucggccaggacaagcacuucgaccaguggguccuccccaacuacuccggggcccugggccugaacaugcaccucgccccggccgugagcccccuguuccccggggagcggcuccuguucuuccgcuccuacaucccccugaagggcggccacggggacccguucaucgacugccuggugccccaggaguggauccagcacuucuaccaggagagcgcgcccgcccaguccagcgucgcccuccugcgguacgugaaccccgacaccggccgcacgcuguucgaggccaagcugcacaaggagggguucaucaccguguccagcaccgagaaccggccggucguggugccgcccaacggcuacuuccgcuucgacuccugggucaaccaguucuacagccucgcgcccauggggaccggcaacggccgccggcgcaugcaguga

SEQ ID NO: 10256 - RNA, 1569 nt, Artificial Sequence
  derived and/or modified sequence opt1 from capsid__Norovirus__ACJ04900
augaagaugaccgaccgcgacaccaucgacagcgcccccgcccugggccaggugcucccgcccgaggucgaggcguccgugcccguggagcccacggccggggccccggucgccgcccccaccgcgggccaggugaaccccaucgaccccuggaucuucgccaacuucgugcaggccccgcagggggaguucaccaucagccccaacaacaaccccggcgagauccuguucgagcuggagcucgggcccgaccugaacccguaccuggcccaccuccggcgcauguacaacggcuggaccggcuccaugcggguccgcgugcugcuggcggggaacgccuucagcgccggcaagguggucguguucugcgugccgcccggguucgacacguccuaccucacccccagccaggccacccaguucccccacguccugaucgacgugcgggcccccgagcccguggagaugccccuggaggacguccgcaacauccucuuccaccagggcccggacucccggaugcgccugauggggaugcuguacacgccccuccgggcgaacagcggcgccgaccccuucguggugaccggccgcguccugaccugccccuccccgaacuucagcuucuucuuccuggugccgcccaccguggaggagcgggagacccccuucacgcuccccaaccugcccgucaacucccugagccacucccgcgccauggagcccaucgcccagaugaugagcucccggaacuucccggccagcgugcaguuccagaacgggcgcugcacccucuccggcgaccugcuggggaccacccccagcucccccgcggacgugggcacguucgucggccucaucgccgagcccgggagccacguggucgagcugagccagccgaaccaggaggacuuccacgccggcuccgcccccgcccccuucggguuccccgacuucagcgacugcucccugaccuucgugguggcgagcgccuccaccgucggcgagcggaccgugaacacgcgcagcccgcagaacuucacccccgcccucgggcacaucaccuucgacgaggaggcccccgccgaccuguuccgggcgcaccuccgcaaccucugggaccccaccgagcacuccuucuggcggaucccggacuaccgcgccgacgugcugggcggcgaguucgcccccagcgucuccgcccccggggugggcgagacgcugcuguucuucaugugcaacgugccccggagcaacggggcgaacccgaaccccugccccugccugcugccccaggaguggaucacccacuucgucuccgagcgcgccgcccuccagagcgacguggcccugcugaacuacaucaacccgaacaccggccgcguccucuucgagugcaagcuguacgccaacggguuccugaccgugaaccucggcgcguccgaccaggccacgcugcccguggacggcaucuucaaguucgugagcugggucuccuucuacuaccagcugcggcccguggggaacaucggcguggggcgccggcucccccgccuggacggcuucuga

SEQ ID NO: 10257 - RNA, 1569 nt, Artificial Sequence
  derived and/or modified sequence opt1 from capsid__Norovirus__ACJ04903
augaagaugaccgaccgcgacaccaucgacagcgcccccgcccugggccaggugcucccgcccgaggucgaggcguccgugcccguggagcccacggccggggccccggucgccgcccccaccgcgggccaggugaaccccaucgaccccuggaucuucgccaacuucgugcaggccccgcagggggaguucaccaucagccccaacaacaaccccggcgagauccuguucgagcuggagcucgggcccgaccugaacccguaccuggcccaccuccggcgcauguacaacggcuggaccggcuccaugcggguccgcgugcugcuggcggggaacgccuucagcgccggcaagguggucguguucugcgugccgcccggguucgacacguccuaccucacccccagccaggccacccaguucccccacguccugaucgacgugcgggcccccgagcccguggagaugccccuggaggacguccgcaacauccucuuccaccagggcccggacucccggaugcgccugauggggaugcuguacacgccccuccgggcgaacagcggcgccgaccccuucguggugaccggccgcguccugaccugccccuccccgaacuucagcuucuucuuccuggugccgcccaccguggaggagcgggagacccccuucacgcuccccaaccugcccgucaacucccugagccacucccgcgugauggagcccaucgcccagaugaugagcucccggaacuucccggccagcgugcaguuccagaacgggcgcugcacccucuccggcgaccugcuggggaccacccccagcucccccgccgaccucggcacguucgucggccugaucgcggagcccgggagccacguggccgagcugagccagccgaaccaggaggacuuccacgccggcuccgcccccgcccccuucggguuccccgacuucagcgagugcucccucaccuucgucguggcgagcgccuccaccgugggcgagcggaccgucaacacgcgcagccugcagaacuucaccccggcccuggggcacaucaccuucgacgaggaggcccccgccgaccucuuccgggcgcaccuccgcaaccugugggaccccaccgagcacuccuucuggcggauccccgacuaccgcgccgacgugcucggcggcgaguucgccccgagcguguccgcccccggggucggcgagacgcugcuguucuucaugugcaacgugccccggcucaacggggcgaaccccaacccgugccccugccugcugccccaggaguggaucacccacuucgugagcgagcgcgccgcccuccaguccgacgucgcccugcugaacuacaucaaccccaacaccggccgcgugcuguucgagugcaagcuguacgugaacggguuccugaccgucaaccucggcgccagcgaccaggcgacgcugccgguggacggcaucuucaaguucguguccugggucagcuucuacuaccagcugcggcccguggggaacaucggcguggggcgccggcucccccgccuggacggcuucuga

SEQ ID NO: 10258 - RNA, 1569 nt, Artificial Sequence
  derived and/or modified sequence opt1 from capsid__Norovirus__ACJ04906
augaagaugaccgaccgcgacgugaccgacagcgcccccgcccugggccagguccucccgcccgagguggaggcguccgugcccgucgagcccacggccggggccccgguggccgcccccaccgcgggccaggugaaccccaucgaccccuggaucuucgccaacuucguccaggccccgcagggggaguucaccaucagccccaacaacaaccccggcgagauccuguucgagcuggagcucgggcccgaccugaacccguaccuggcccaccuccggcgcauguacaacggcuggaccggcuccaugcgggugcgcgugcugcuggcggggaacgccuucagcgccggcaaggucgugguguucugcgucccgcccggguucgacacguccuaccucacccccagccaggccacccaguucccccacgugcugaucgacgugcgggcccccgagcccgucgagaugccccuggaggacgugcgcaacauccucuuccaccagggcccggacucccggaugcgccugauggggaugcuguacacgccccuccgggcgaacagcggcgccgaccccuucguggucaccggccgcgugcugaccugccccuccccgaacuucagcuucuucuuccuggugccgcccaccgucgaggagcgggagccgcccuucacccuccccaaccugcccgugaacaaccugucccacagccgcgugauggagcccaucgcccagaugauguccagccggaacuuccccgccuccguccaguuccagaacgggcgcugcacgcucagcggcgaccugcuggggaccacccccuccagccccuccgaccucggcgccuucgugggccugaucgcggagccggggagccgggucguggagcugagccagcccaaccaggaggacuuccacgccggcuccgcccccgcccccuucggguucccggacuucagcgacugcucccucaccuucguggucgccagcgcgacgaccgugggcgagcgcaccgugaacgcccggagcccccagaacuucacccccgcccuggggcacaucacguucgacgaggaggcccccgccgaccuguuccgcgcgcaccuccggaaccugugggacccgaccgagcacuccuucuggcgcauccccgacuaccgggccgacguccugggcuccgaguucgcccccagcguguccgcccccggcgugggggagacccuccuguucuucaugugcaacgucccgcgccugaacggcgcgaaccccaaccccugccccugccuccugccgcaggaguggaucacccacuucgugagcgagcgcgccgcccugcaguccgacguggcccuccugaacuacgucaaccccaacacggggcgggugcuguucgaggccaagcucuacgcgaacggcuuccugaccgugaaccugggggccagcgaccaggccacccuccccgucgacggcaucuucaaguucguguccugggugagcuucuacuaccagcugcgccccgucggcaacgccuccguggggcggcgccugccgcggcucgacggcuucuga

SEQ ID NO: 10259 - RNA, 1623 nt, Artificial Sequence
  derived and/or modified sequence opt1 from capsid__Norovirus__ACY00565
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagagcgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgaccccaccgaggagaucccggcgccccucgggacgcccgacuucgugggcaagauccaggggguccugacccagaccaccaagggcgacgggagcacgcggggccacaaggccaccguguacaccggcagcgcccccuucaccccgaagcugggguccgugcaguucagcacggacaccgagaacgacuucgagacccaccagaacaccaaguucacgcccgucggcgugauccaggacgggggcaccacccaccgcaacgagccccagcagugggugcuccccuccuacagcgggcggaacgucccgaacgugcaccuggcccccgccguggcgcccaccuuccccggcgagcagcuccucuucuuccgcuccacgaugccgggcugcagcggguaccccaacgucgaccuggacugccugcucccccaggagugggugcagcacuucuaccaggaggccgcccccgcccaguccgacguggcgcugcugcgguucgucaacccggacaccggccgcguccucuucgagugcaagcugcacaagagcggguacgugaccguggcccacaccggccagcacgaccuggugaucccgcccaacggguacuuccgguucgacuccugggugaaccaguucuacacccucgcccccaugggcaacggcacggggcgccggcgcgcccuguga

SEQ ID NO: 10260 - RNA, 1623 nt, Artificial Sequence; identical to SEQ ID NO: 10086
  derived and/or modified sequence opt1 from capsid__Norovirus__ACY00568

SEQ ID NO: 10261 - RNA, 1623 nt, Artificial Sequence
  derived and/or modified sequence opt1 from capsid__Norovirus__ACY00571
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccaaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacguccagaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 10262 - RNA, 1623 nt, Artificial Sequence
  derived and/or modified sequence opt1 from capsid__Norovirus__ACY00573
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcgggacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcgcccuguga

SEQ ID NO: 10263 - RNA, 1623 nt, Artificial Sequence
  derived and/or modified sequence opt1 from capsid__Norovirus__ACY00576
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcacccacaacuacaccaugaaccuggccucccugaacuggaacaacuacgaccccacggaggagaucccggcgccccucgggacccccgacuucgugggcaagauccaggggguccugacccagaccacgaagggcgacgggagcacccgcggccacaaggccaccguguacaccggcuccgcccccuucacgccgaagcuggggagcgugcaguucagcaccgacaccgagaacgacuucgagacccaccagaacacgaaguucacccccgucggcgugauccaggacggguccaccacccaccggaacgagccccagcagugggugcuccccagcuacuccggcgggaacguccagaacgugcaccuggccccggccguggcgcccacguuccccggcgagcagcuccucuucuuccgcagcaccaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacagccgguucgaccccugggugaaccaguucuacacgcucgcccccaugggcaacggcaccgggcgccggcgcgcccuguga

SEQ ID NO: 10264 - RNA, 1623 nt, Artificial Sequence
  derived and/or modified sequence opt1 from capsid__Norovirus__ACY00579
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccagcaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccggccccuccagcgccuucgugguccagccgcagaacgggcgcugcacgaccgacggcgugcugcuggggaccacccagcucucccccgucaacaucugcacguuccggggcgacgugacccacaucgccggcacccacaacuacaccaugaaccuggccagccugaacuggaacaacuacgaccccacggaggagaucccggcgccccucgggacccccgacuucgugggcaagauccaggggguccugacccagaccacgaagggcgacggguccacccgcggccacaaggccaccguguacaccggcagcgcccccuucacgccgaagcuggggagcgugcaguucuccaccgacaccgagaacgacuucgagacccaccagaacacgaaguucacccccgucggcgugauccaggacgggagcaccacccaccggaacgagccccagcagugggugcuccccuccuacagcggcgggaacguccagaacgugcaccuggccccggccguggcgcccacguuccccggcgagcagcuccucuucuuccgcuccaccaugcccggcugcagcggguacccgaacauggaccuggacugccugcucccccaggaguggguccagcacuucuaccaggaggccgcccccgcccaguccgacguggcgcugcugcgguucgugaaccccgacaccggccgcguccucuucgagugcaagcugcacaagagcggguacgugaccguggcccacaccggccagcacgaccuggucaucccgcccaacggguacuuccgguucgacuccugggugaaccaguucuacacgcucgcccccaugggcaacggcaccgggcgccggcgcgcccuguga

SEQ ID NO: 10265 - RNA, 1623 nt, Artificial Sequence
  derived and/or modified sequence opt1 from capsid__Norovirus__ACY00582
augaagauggccagcaacgacgccaaccccuccgacggcagcguggcgaaccuggucccggaggugaacaacgaggugauggcccucgagcccgucgugggggccgccaucgccgcgcccguggccggccagcagaacgucaucgaccccuggauccgcaacaacuucgugcaggcccccgggggcgaguucaccgugagcccccggaacgcccccggggagauccugugguccgcgccccugggcccggaccucaaccccuaccugucccaccuggcccgcauguacaacggcuacgccgggggcuucgagguccaggugauccucgccgggaacgccuucaccgcgggcaagaucaucuucgccgccgugccgcccaacuucccgacggaggggcugagccccucccaggucaccauguucccccacaugaucguggacgugcggcagcuggagcccguccucaucccgcugcccgacgugcgcaacaacuucuaccacuacaaccagagcaacgacuccaccaucaagcugaucgccaugcucuacacgccccugcgggccgacaacgcgggcgaggacguguucaccgucagcugccgcgugcugacccggcccuccccggacuucgacuucaucuuccucgugccgcccaccgucgagagcaagaccaagcccuucacggugcccauccugaccguggaggagaugaccaacucccgcuuccccaucccccuggagaagcuguucaccggccccagcuccacguucgucgugcagccgcagaacgggcggugcaccaccgacggcguccugcuggggaccacgcagcucagccccgugaacaucugcaccuuccgcggcgacgugacccacaucgccggcucccggaacuacaccaugaaccuggccagccugaacuggaacaacuacgaccccacggaggagaucccggcgccccucgggacccccgacuucgucggcaagauccagggggugcugacccagaccacgaagggcgacggguccacccgcggccacaaggccaccguguacaccggcagcgcccccuucacgccgaagcuggggagcguccaguucuccaccgacaccgagaacgacuucgagacccaccagaacacgaaguucacccccgugggcgugauccaggacgggagcaccacccaccggaacgagccccagcaguggguccuccccuccuacagcggccgcaacgugcacaacgugcaccuggccccggccgucgcccccacguuccccggggagcagcuccucuucuuccgguccaccaugcccggcugcagcggcuacccgaacauggaccuggacugccugcucccccaggagugggugcagcacuucuaccaggaggccgcgcccgcccaguccgacguggcccugcugcgcuucgucaaccccgacaccgggcggguccucuucgagugcaagcugcacaagagcggcuacgugaccguggcccacaccgggcagcacgaccuggugaucccgcccaacggcuacucccgcuucgacagcugggugaaccaguucuacacgcucgcgcccauggggaacggcaccggccggcgccgggcccuguga

SEQ ID NO: 10266 - RNA, 1623 nt, Artificial Sequence
  derived and/or modified sequence opt1 from capsid__Norovirus__ACY00588
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggccauccucgccgggaacgccuucaccgccggcaagaucaucuucgccgccgucccgcccaacuucccgacggaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgcgaugcucuacacgccccugcgggccaacaacgccggcgaggacgucuucaccgugagcugccgcgugcugacccggcccuccccggacuucgacuucaucuuccucgucccgcccaccguggagagccgcaccaagcccuucacggugcccauccugaccgucgaggagaugaccaacucccgguuccccaucccccuggagaagcuguucaccggccccagcuccgccuucguggugcagccgcagaacgggcgcugcacgaccgacggcguccuccuggggaccacccagcucagccccgugaacaucugcacguuccggggcgacgucacccacaucgccggcucccgcaacuacaccaugaaccuggcgagccugaacuggaacaacuacgaccccaccgaggagaucccggcgccccucgggacgcccgacuucgugggcaagauccagggggugcugacccagaccaccaagggcgacggguccacgcggggccacaaggccaccgucuacaccggcagcgcccccuucaccccgaagcuggggagccuccaguucuccacggacaccgagaacgacuucgagacccaccagaacaccaaguucacgcccgugggcgugauccaggacgggggcaccacccaccgcaacgagccccagcaguggguccugcccagcuacuccgggcggaacgugccgaacgugcaccuggcccccgccgucgcccccaccuuccccggcgagcagcuccuguucuuccgcagcacgaugccgggcugcuccggguaccccaacauggaccuggacugccuccugccccaggagugggugcagcacuucuaccaggaggccgcccccgcgcagagcgacguggcccugcuccgguucgucaacccggacaccggccgcgugcuguucgagugcaagcugcacaaguccggguacgugaccgucgcccacaccggccagcacgaccucgugaucccgcccaacggguacuuccgguucgacagcugggugaaccaguucuacacccuggcccccaugggcaacggcacggggcgccggcgcgcccuguga

SEQ ID NO: 10267 - RNA, 1623 nt, Artificial Sequence
  derived and/or modified sequence opt1 from capsid__Norovirus__ACY00594
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagcccaacgacagcaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcaccaagcccuucacgguccccauccugaccguggaggagaugaccaacagccgguuccccaucccccuggagaagcuguucaccggcccguccagcgccuucgugguccagccccagaacgggcgcugcacgaccgacggcgugcugcuggggaccacccagcucucccccgucaacaucugcacguuccggggcgacgugacccacaucgccggcagccgcaacuacaccaugaaccuggccucccugaacuggaacaacuacgacccgaccgaggagauccccgcgccccucgggacgcccgacuucgugggcaagauccaggggguccugacccagaccaccaagggcgacgggagcacgcacggccacaaggccaccguguacaccggcuccgccccguucacccccaagcuggggagcgugcaguucagcacggacaccgagaacgacuucgagacccaccagaacaccaaguucacgcccgucggcgugauccaggacggguccaccacccaccggaacgagccccagcagugggugcucccgagcuacuccggccgcaacguccagaacgugcaccuggcccccgccguggcgcccaccuuccccggggagcagcuccucuucuuccggagcacgaugccgggcugcuccggcuaccccaacauggaccuggacugccugcucccccaggaguggguccagcacuucuaccaggaggccgcccccgcccagagcgacguggcgcugcugcgcuucgugaacccggacaccgggcggguccucuucgagugcaagcugcacaaguccggcuacgugaccguggcccacaccgggcagcacgaccuggucaucccgcccaacggcuacuuccgcuucgacagcugggugaaccaguucuacacccucgcccccauggggaacggcacgggccggcgccgggcccuguga

SEQ ID NO: 10268 - RNA, 1623 nt, Artificial Sequence
  derived and/or modified sequence opt1 from capsid__Norovirus__ACY00597
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucggcgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccgggcccagcuccgccuucgugguccagccgcagaacggccgcugcacgaccgacggggugcugcugggcaccacccagcucagccccgucaacaucugcacguucaagggcgacgugacccacaucgccgggucccggaacuacaccaugaaccuggccagccugaacuggaacaacuacgaccccaccgaggagaucccggcgccccucggcacgcccgacuucguggggaagauccagggcguccugacccagaccaccaagggggacggcuccacgcgcggccacaaggccaccguguacaccgggagcgcccccuucaccccgaagcugggcagcgugcaguucuccacggacaccgagaacgacuucgagacccaccagaacaccaaguucacgcccgucggggugauccaggacggcgggaccacccaccggaacgagccccagcagugggugcuccccagcuacuccggccgcaacguccagaacgugcaccuggccccggccguggcgcccaccuuccccggcgagcagcuccucuucuuccggagcacgaugcccgggugcuccggcuacccgaacauggaccuggacugccugcucccccaggaguggguccagcacuucuaccaggaggccgcccccgcccagagcgacguggcgcugcugcgcuucgugaaccccgacaccgggcggguccucuucgagugcaagcugcacaaguccggcuacgugaccguggcccacaccgggcagcacgaccuggucaucccgcccaacggcuacuuccgcuucgacagcugggugaaccaguucuacacccucgcccccaugggcaacgggacgggccggcgccgggcccuguga

SEQ ID NO: 10269 - RNA, 1623 nt, Artificial Sequence
  derived and/or modified sequence opt1 from capsid__Norovirus__ACY00600
augaagauggccagcaacgacgccaaccccuccgacggccccgcggccaaccuggugcccgaggucaacaacgaggugauggcccucgagcccguggucggggccgccaucgcggcccccguggccggccagcagaacgugaucgacccguggauccgcaacaacuucguccaggcccccgggggcgaguucaccgugagcccccggaacgcgcccggggagauccugugguccgccccgcugggccccgaccucaaccccuaccugagccaccuggcccgcauguacaacggcuacgccgggggcuucgaggugcaggucauccucgccgggaacgcguucaccgccggcaagaucaucuucgccgccgugcccccgaacuuccccacggaggggcugucccccagccaggugaccauguucccccacaucaucgucgacgugcggcagcuggagccggugcucaucccccugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggccgagccccgacuucgacuucaucuuccucgugccgcccaccguggagucccgcaccaagcccuucacgguccccauccugaccguggaggagaugaccaacagccgguuccccaucccccuggagaagcuguucaccggcccguccagcgccuucgugguccagccccagaacgggcgcugcacgaccgacggcgugcugcuggggaccacccagcucucccccgucaacaucugcacguuccggggcgacgugacccacaucgccggcagcuccaacuacaccaugaaccuggccagccugaacuggaacaacuacgacccgaccgaggagauccccgcgccccucgggacgcccgacuucgugggcaagauccaggggguccugacccagaccaccaagggcgacggguccacgcgcggccacaaggccaccguguacaccggcagcgccccguucacccccaagcuggggagcgugcaguucuccacggacacccagaacgacuucgagacccaccagaacaccaaguucacgcccgucggcgugauccaggacgggggcaccacccaccggaacgagccccagcagugggugcucccgagcuacuccgggcgcaacguccagaacgugcaccuggcccccgccguggcgcccaccuuccccggcgagcagcuccucuucuuccggagcacgaugccgggcugcuccggguaccccaacauggaccuggacugccugcucccccaggaguggguccagcacuucuaccaggaggccgcccccgcccagagcgacguggcgcugcugcgcuucgugaacccggacaccggccggguccucuucgagugcaagcugcacaagucccgcuacgugaccguggcccacaccgggcagcacgaccuggucaucccgcccaacggcuacuuccgguucgacagcugggugaaccaguucuacacccucgcccccauggggaacggcacgggccgccggcgcgcccuguga

SEQ ID NO: 10270 - RNA, 1623 nt, Artificial Sequence
  derived and/or modified sequence opt1 from capsid__Norovirus__ACY00603
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgcccugaccgccggcaagaucaucuucgccgccgugccgcccaacuucccgacggaggggcugagccccucccaggugaccauguucccccacaucaucgucgacgugcggcagcucgagcccgugcugaucccgcugcccgacguccgcaacaacuucuaccacuacaaccagagcaacgacuccaccaucaagcucaucgccaugcuguacacgccccugcgggcgaacaacgccggcgaggacguguucaccgugagcugccgcguccucacccggcccuccccggacuucgacuucaucuuccuggugccgcccaccguggagagccgcaccaagcccuucacgguccccauccugaccguggaggagaugaccaacucccgguuccccaucccccucgagaagcuguucaccggccccagcuccgccuucgugguccagccgcagaacgggcgcugcacgaccgacggcgugcugcucgggaccacccagcugagccccgucaacaucugcacguuccggggcgacgugacccacaucgccggcucccgcaacuacaccaugaaccuggccagccucaacuggaacaacuacgaccccaccgaggagaucccggcgccccuggggacgcccgacuucgugggcaagauccaggggguccccacccagaccaccaagggcgacggguccacgcggggccacaaggccaccguguacaccggcagcgccccguucacccccaagcuggggagcgugcaguucuccacggacaccgagaacgacuucgaggcccaccagaacaccaaguucacccccgucggcgugauccaggacgggggcacgacccaccgcaacgagccccagcagugggugcucccgagcuacuccgggcggaacguccccaacgugcaccuggcccccgcgguggcccccaccuucccgggcgagcagcuccuguucuuccgcagcaccaugcccggcugcuccggguaccccaacauggaccuggacugccugcucccccaggaguggguccagcacuucuaccaggaggccgccccggcgcagagcgacguggcccugcugcgguucgugaaccccgacacgggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcaccgggcgccggcgcgcccuguga

SEQ ID NO: 10271 - RNA, 1623 nt, Artificial Sequence
  derived and/or modified sequence opt1 from capsid__Norovirus__ACY00606
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcagaugauccucgccgggaacgccuucaccgccggcaagaucaucuucgccgccgucccgcccaacuucccgacggaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgccaugcucuacacgccccugcgggcgaacaacgccggcgaggacgucuucaccgugagcugccgcgugcugacccggcccuccccggacuucgacuucaucuuccucgucccgcccaccguggagagccgcaccaagcccuucacggugcccauccugaccgucgaggagaugaccaacucccgguuccccaucccccuggagaagcuguucaccggccccagcuccgccuucguggugcagccgcagaacgggcgcugcacgaccgacggcguccugcuggggaccacccagcucagccccgugaacaucugcacguuccggggcgacgucacccacaucgccggcucccgcaacuacaccaugaaccuggccagccugaacuggaacaacuacgaccccaccgaggagaucccggcgccccucgggacgcccgacuucgugggcaagauccagggggugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggggcaccacccaccgcaacgagccccagcagugggugcuccccagcuacuccgggcggaacgugccgaacguccaccuggcccccgccguggcgcccaccuuccccggcgagcagcuccucuucuuccgcagcacgaugccgggcugcuccggguaccccaacauggaccuggacugccugcucccccaggagugggugcagcacuucuaccaggaggccgcccccgcccagagcgacgucgcgcugcugcgguucgugaacccggacaccggccgcguccucuucgagugcaagcugcacaaguccggguacgugaccguggcccacaccggccagcacgggcuggugaucccgcccaacggcuacuuccgguucgacagcugggucaaccaguucuacacccucgcccccaugggcaacgggacgggccgccggcgcgcccuguga

SEQ ID NO: 10272 - RNA, 1623 nt, Artificial Sequence
  derived and/or modified sequence opt1 from capsid__Norovirus__ACY00609
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccgaccccagcuccgccuucgugguccagccgcagaacggccgcugcacgaccgacggggugcugcugggcaccacccagcucagccccgucaacaucugcacguuccgcggggacgugacccacaucgccggcucccggaacuacaccaugaaccuggccagccugaacuggaacaacuacgaccccaccgaggagaucccggcgccccucggcacgcccgacuucguggggaagauccagggcguccugacccagaccaccaagggggacggcuccacgcgggggcacaaggccaccguguacaccggcagcgcccccuucaccccgaagcugggcagcgugcaguucuccacggacaccgagaacgacuucgagacccaccagaacaccaaguucacgcccgucggggugauccaggacggcgggaccacccaccgcaacgagccccagcagugggugcuccccagcuacuccggccggaacgucccgaacgugcaccuggcccccgccguggcgcccaccuuccccggggagcagcuccucuucuuccgcagcacgaugccgggcugcuccggcuaccccaacauggaccuggacugcccccugccccaggaguggguccagcacuucuaccaggaggccgccccggcccagagcgacguggcgcuccugcgguucgugaaccccgacaccgggcgcguccuguucgagugcaagcuccacaaguccggcuacgugaccguggcccacaccgggcagcacgaccuggucaucccgcccaacggcuacuuccgguucgacagcugggugaaccaguucuacacccuggcccccauggggaacggcacgggccgccggcgcgcccucuga

SEQ ID NO: 10273 - RNA, 1623 nt, Artificial Sequence
  derived and/or modified sequence opt1 from capsid__Norovirus__ACY00612
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucaugggcaagauccagggggugcugacccagaccaccaagggcgacggguccacgcggggccacaaggccaccgucuacaccggcagcgcccccuucaccccgaagcuggggagcgugcaguucuccacggacaccgagaacgacuucgagacccaccagaacaccaaguucacgcccgugggcgucauccaggacgggggcaccacccaccgcaacgagccccagcagugggugcuccccagcuacuccgggcggaacgugccgaacguccaccuggcccccgccguggcgcccaccuuccccggcgagcagcuccucuucuuccgcagcacgaugccgggcugcuccggguaccccaacauggaccuggacugccugcucccccaggagugggugcagcacuucuaccaggaggccgcccccgcccagagcgacgucgcgcugcugcgguucgugaacccggacaccggccgcguccucuucgagugcaagcugcacaaguccggguacgugaccguggcccacaccggccagcacgaccuggugaucccgcccaacggguacuuccgguucgacagcugggucaaccaguucuacacccucgcccccaugggcaacggcacggggcgccggcgcgcccuguga

SEQ ID NO: 10274 - RNA, 1632 nt, Artificial Sequence
  derived and/or modified sequence opt1 from capsid__Norovirus__ACY00615
augaugauggccagcaaggacgcccccaccaacauggacggcaccuccggggcgggccagcuggugccggaggccaacacggccgagccccuccccaucaagcccgucgccggggccgcgaccgccguggccaccgccggccaggugaacaugaucgacccguggaucaugaacaacuucguccaggcgccccagggggaguucaccaucagccccaacaacacgcccggcgacauccuguucgaccugcagcucggcccgcaccugaaccccuuccuggcccaccucucccgcauguacaacgggugggugggcaacaugcagguccggaucaugcuggccgggaacgccuucagcgccggcaagaucaucgugugcugcaucccgcccggguucuccagccaguccaucagcaucgcgcaggccaccauguucccccacgugaucgccgacgugcgcguccuggagcccaucgacgugccccucgacgacgugcggaacguccuguuccacaacaacgacaacccccagaccaugcgccugcucugcaugcuguacaccccgcugcgguccggcggcacgagcuccgggaccgaccccuucgugaucgccggccgcgugcugaccugccccacccccgacuucagcuuccucuuccuggucccgcccgacaucgagcagcggacgaagcccuucuccgugcccaacaucccgaugaaccucaugagcaacucccgcgugagcaugcugaucgacgggaugauggucuccaacgaccagaaccaggugccccaguuccagaacggccgggugacccuggacggccagcuccaggacaccaccacggucagcgccgcgugcguggcccgcaugcgggggcgcaucuucaacaacaacggcaacuacggggugaaccugaccgagcuggacggcaaccccuaccacgccuucgacucccccgccccgcucggguuccccgacuucggcaacugcgaccugcacaugaccuucgucaagaucaaccccaacgagcugagcagcggcgacccguccgggaagguggucauccacagcuacgacgccaccuucgcgccccaccucggcacggugaagcuggagaacgacgacgagcuggcccgguucguggggaaggaggucgugcucgagcugaccuggguguccaaccgcgagggcgccacccugaaccucugggccguccccaacuacgggagcucccugacccaggccagccagcuggcgcccccgaucuacccgcccggcuucggcgaggccaucguguacuucacguccaccuuccccaccgugagcaaccccaagguccccugcacccucccccaggaguucgugucccacuucgugaacgagcaggcccccacgcgcggggacgccgcgcugcugcacuacgucgacccggacacccaccggaaccucggcgaguucaagauguaccccgagggguacaugaccugcgugcccaacgccggcgggggcccccagacccugccgaucaacggcguguucgucuucaucagcugggugucccgguacuaccagcugaagcccguggggacggccggcgccgcccgccggcucgggcugcgccggagcuga

SEQ ID NO: 10275 - RNA, 1623 nt, Artificial Sequence
  derived and/or modified sequence opt1 from capsid__Norovirus__ACY00618
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacauggucgaccccuggaucuucaacaacuucgugcaggcgccgcagggggaguucaccaucucccccaacaacacccccggcgacauccucuucgaccugcagcugggcccccaccucaacccguuccuggcccaccugagccagauguacaacgggugggugggcaacaugcgcguccggauccuccuggccgggaacgccuucacggccggcaagaucaucaucugcugcgugccgcccggguucgacgcgcgcauccugaccaucgcccaggccacccucuucccccaccugaucgccgacgugcggacccuggagcccgucgagcucccccuggaggacgugcgcaacgugcuguaccacaacuccagccagccccagcccacgaugcggcucgucgccaugcuguacaccccgcugcgcaccggcggcggguccggcgggaccgacgcguucgugguggccggccggguccucacgugccccgcccccgacuucagcuuccuguuccuggugcccccguccguggagcagaagacccgcgucuucagcgugcccaacaucccccucaaggaccuguccaacagccgggugcccgucccgauccagggcauguucaugucccccgacgugaaccagagcgugcaguuccagaacgggcgcugccagaucgacggccagcugcaggggaccacccccgucucccucagccagcugugcaagauccggggcaagacguccagcaacgcccgcgugcugaaccucagcgaggucgacgggacccccuucaucccgcuggagucccccgcccccgugggcuucccggaccugggcgggugcgacuggcacgugaacuucaccuuccagacccaggaccgggaccccagccaguccgucacguucgcgaccaacgacgccagcuucgugcccuaccucggcuccgugagcccccacaacggggagggcuuccaggccggggacaucaucggcucccugggcuggaucagcgccccguccgacaacagccaguucaacgucugggccauccccaaguacggguccagccugcccgacgugacccaccucgcgcccgccguguucccgcccggcuucggggaggucauccuguacuucuacuccaccuuccccggcagcgggcagcccucccagcuccaggugccgugccugcugccccaggaguucaucacgcacuucugcaacgagcaggcccccaucgccggcgaggcggcccugcuccacuacguggaccccgacaccggccgcaaccugggggaguucaagcuguacccggacggcuucaugaccugcguccccaacagcguguccagcgggccccagacccuccccaucaacggcguguucgucuucguguccugggugagccgguucuaccagcugaagccggucggcacggccagcgccgcccgccggcuggggcuccgccggaucuga

SEQ ID NO: 10276 - RNA, 1623 nt, Artificial Sequence
  derived and/or modified sequence opt1 from capsid__Norovirus__ACY00621
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgauccagggcauguucaugucccccgacgucaaccagagcgugcaguuccagaacgggcgcugccagaucgacggccagcugcaggggaccacccccgugucccucagccagcugugcaagauccggggcaagacguccagcaacgcccgcguccugaaccucagcgagguggacgggacccccuucaucccgcuggagucccccgcccccgucggcuucccggaccugggcgggugcgacuggcacgugaacuucaccuuccagacccaggaccgggaccccagccaguccgugacguucgcgaccaacgacgccagcuucguccccuaccucggcuccgugagcccccacaacggggagggcuuccaggccggggacaucaucggcucccugggcuggaucagcgccccguccgacaacagccaguucaacgugugggccauccccaaguacggguccagccugcccgacgucacccaccucgcgcccgccguguucccgcccggcuucggggaggugauccuguacuucuacuccaccuuccccggcagcgggcagcccucccagcugcaggucccgugccuccugccccaggaguucaucacgcacuucugcaacgagcaggcccccaucgccggcgaggcggcccugcuccacuacguggaccccgacaccggccgcaaccugggggaguucaagcuguacccggacggcuucaugaccugcgugcccaacagcgucuccagcgggccccagacccuccccaucaacggcguguucguguucgucuccugggugagccgguucuaccagcugaagccggugggcacggccagcgccgcccgccggcuggggcuccgccggaucuga

SEQ ID NO: 10277 - RNA, 1611 nt, Artificial Sequence
  derived and/or modified sequence opt1 from capsid__Norovirus__ACY00623
augaagauggccagcaacgacgccacccccuccgacgacggcgcggccgggcuggugccgggcaucaacagcgaggucauggcccucgagcccguggccggggccuccaucgcggcccccguggucggccagcagaacaucaucgaccccuggauccgcaacaacuucgugcaggccccggccggggaguucaccgugagcccccggaacucccccggcgagcugcugcucgaccuggagcugggccccgagcucaacccguaccuggcgcaccuggcccgcauguacaacgggcacgccggcgggauggagguccagaucgugcucgccggcaacgccuucacggcgggggagauccuguucgccgccaucccgcccagcuuccccuacgagaaccugucccccgcccagcucaccaugugcccccacgugaucgucgacgugcggcagcuggagcccgugcugcuccccaugccggacauccgcaacgucuucuaccacuacaaccagaacaacagccccaagcugcggcugguggccaugcucuacacgccccugcgcgcgaacaacuccggcgacgacguguucaccgucagcugccgggugcugacccgccccuccccggacuuccaguucaccuuccucgugccgcccaccgucgagagcaagaccaagaacuucacgcugcccgugcugcggguguccgagaugaccaacagccgcuuccccgucgugcucgaccagauguacaccucccggaacgagaacaucaucgugcagccccagaacggccgcugcaccacggacggggagcugcugggcaccaccauccuccagagcgucuccaucugcaacuucaaggggaccaugcaggccaagcugaacgaggagccccgguaccagcugcagcucacgaaccuggacggcagccccaucgacccgaccgacgacaugcccgcgccccugggcaccccggacuuccaggccaugcucuacgggguggccucccagcgcagcagcaccgacaacgccacgcgggcccacgacgcccagaucgacaccgccggcgacaccuucgcccccaagaucgggcagguccgcuucaaguccagcuccaacgacuucgaccugcacgaccccaccaaguucacgcccaucggcgugaacguggacgaccagcacccguuccggcaguggagccugcccaacuacgggggccaccucgcgcugaacaaccaccuggcccccgccgucacgccccucuucccgggcgagcagauccuguucuuccgcuccuacauccccagcgccgggggccacaccgacggggcgauggacugccugcucccccaggaguggguggagcacuucuaccaggaggccgcccccucccagagcgacaucgcccuggugcgguucaucaacccggacaccggccgcguccuguucgaggccaagcuccacaagcagggguuccugaccaucgcggccuccggcgaccaccccaucgugaugcccaccaacggcuacuuccgguucgaggccugggugaaccccuucuacacccuggccccggucgggaccggcagcgggcgccgccggauccaguga

SEQ ID NO: 10278 - RNA, 1647 nt, Artificial Sequence
  derived and/or modified sequence opt1 from capsid__Norovirus__ACY00629
augaagauggccagcaucgacgccgcgcccuccaacgacggcgccgccgggcuggugccggagaucaacaacgaggccauggcccucgaccccgucgcgggcgccgccaucgccgcgccccugaccgggcagcagaacaucaucgaccccuggaucaugaacaacuucgugcaggccccgggcggggaguucaccgugagcccccgcaacucccccggcgagguccugcucaaccuggagcugggccccgagaucaacccguaccucgcccaccuggcccggauguacaacggguucgccggcggguucgagguccaggugguccuggcgggcaacgccuucacggccgggaagaucaucuucgccgccaucccgcccaacuuccccaucgacaaccucagcgcggcccagaucaccaugugcccccacgugaucguggacguccgccagcuggagcccgugaaccugcccaugcccgacgugcggaacaacuucuuccacuacaaccagggcuccgacagcaagcuccgccuggucgccaugcuguacaccccgcuccgggccaacaacuccggcgacgacguguucaccgugagcugccgcguccugacgcggcccucccccgacuucagcuucaacuuccuggugcccccgaccguggaguccaagaccaagcccuucacccuccccauccugacgaucagcgagauguccaacagccgcuuccccgucccgaucgacucccugcacaccagccccaccgagaacaucguggugcagugccagaacgggcgggucacccucgacggcgagcugauggggacgacccagcugcuccccucccagaucugcgccuuccgcggcgugcugacccggagcaccucccgcgcgagcgaccaggccgacacggccacgccccggcuguucaacuacuacuggcacauccagcucgacaaccugaacggcaccccguacgaccccgccgaggacauccccgggccgcugggcacccccgacuuccgcgggaagguguucggcgucgccagccagcggaaccccgacuccaccacccgcgcgcacgaggccaagguggacaccaccgccgggcgguucacgcccaagcucggcagccuggagaucuccaccgagagcgacgacuucgaccagaaccagccgacccgcuucacccccgucggcaucgggguggaccacgaggccgacuuccagcaguggucccugcccgacuacagcggccaguucacgcacaacaugaaccucgcgcccgccguggccccgaacuuccccggggagcagcugcuguucuuccggucccagcuccccagcuccggcgggcgcagcaacggcauccuggacugccuggucccccaggagugggugcagcacuucuaccaggaguccgccccggcccagacccagguggcgcucguccgguacgugaaccccgacaccggccgcgugcuguucgaggccaagcugcacaagcucggguucaugaccaucgccaagaacggcgacagccccaucacggugcccccgaacggguacuuccgcuucgaguccugggugaaccccuucuacacccuggugcccaugggcaccgggaacggccggcgccggauccaguga

SEQ ID NO: 10279 - RNA, 1614 nt, Artificial Sequence
  derived and/or modified sequence opt1 from capsid__Norovirus__ACY00632
auggccagcaacgacgccgcgcccuccaacgacggcgccaccgggcuggugccggagaucaacaccgagacgcucccccuggagcccgucgccggcgccgccaucgcggcccccgugaccgggcagaacaacaucaucgacccguggauccgcaacaacuucgugcaggcccccaacggcgaguucaccgucagcccccggaacucccccggggagauccugaugaaccucgagcugggcccggaccugaaccccuaccucgcccaccugagccgcauguacaacggcuacgccgggggcguggaggugcagguccugcucgccgggaacgccuucaccgccggcaagauccuguucgccgcggugccgcccaacuuccccguggacaugcugucccccgcccagaucacgaugcucccccaccugaucgucgacgugcggacccuggagcccaucaugaucccgcuccccgacgugcgcaacgucuucuaccacuucaacaaccagcccgcgccccggaugcgccugguggccaugcuguacaccccgcuccggagcaacggguccggcgacgacguguucaccgucagcugccgcgugcugacgcggcccacccccgacuucgaguucaccuaccuggugcccccguccgucgagagcaagaccaagcccuucacgcuccccauccugaccaucggcgagcugaccaacucccgcuuccccgccccgaucgaccagcucuacaccagccccaacgcggacaucguggugcagccccagaacgggcggugcacgcuggacggcgagcugcaggggaccacccagcuccugaccacggccaucugcuccuaccgcggcaugaccagcaacccgaccuccgacuacugggacgaccaccuccugcaccugguccaccccaacggcgccaccuacgaccccacggaggacgugcccgccccguucgggacccaggacuuccggggcauccuguacgggaugcucacccagaacccccgcaccagcggcgacgaggccgcgaacucccacgggaucuacaucagcuccacgagcgagaaguucacccccaagcugggcaccaucggccugcaccaggugcaggggcggcacagccagcaccagcaguccaaguucacccccgucggcaucgccgugaacgggaacacgccguuccgccagugggagcuccccaacuacagcggcgcccugacccugaacaccaaccucgcccccgccgucgggcccaacuucccgggcgagcagauccuguucuuccgguccaacgugcccagcgugcagggcgggcagcccaucgagaucgacugccugaucccccaggagugggucucccacuucuaccaggagagcgcgccgucccagagcgacguggcccucgugcgcuacgucaaccccgacaccggccggacgaucuucgaggccaagcugcaccgccagggguucaucaccaucgccgcgaccggcuccaaccccgugguggugcccccgaacggguacuuccgguucgacagcugggucaaccaguucuacgcccuggcccccaugggcaccggcaacgggcgccgccgggugcaguga

SEQ ID NO: 10280 - RNA, 1617 nt, Artificial Sequence
  derived and/or modified sequence opt1 from capsid__Norovirus__ACY00635
augaagauggccagcaacgacgccgcgcccuccaacgacggcgccgccgggcuggugcccgagaucaacaacgaggucauggcccucgagcccguggccggcggggcgaucgccgcgccccugaccggccagaccaacgugaucgaccccuggauccgcacgaacuucguccaggccccgaacggggaguucaccaucagcccccggaacucccccggcgaggugcugcucaacauggagcugggccccgagcugaacccguuccucgggcaccugagccgcauguacaacggcuacgccgggggcaucgaggugcagguccugauggccgggaacgccuucaccgccggcaaggugaucuucgccgcggugccgccccacuuccccgucgagaaccucuccccgccccaggugaccauguucccccacgugaucgucgacgugcggacgcuggagcccauccugcucccccugcccgacgugcgcaaccaguucuuccacuacagccaggucgacgagcccaagaugcggcugguggccaugcucuacacgccccugcgcuccaacggcagcgccgaggacguguucaccgucuccugccgggugcugacccgcccgagccccgacuucgaguucaacuaccucgugccgcccaccgucgagucccggaccaagcccuucaccgugcccauccugaccaucggggagaugagcaacucccgcuuccccgcccccaucgacgugaucuacacgagcccgaacgacaaccagaacguccagccccagaacggccggugcacccuggacggggagcuccagggcaccacccagcuggugcccuccggcgucugcgccuuccgcgggcggaucacgagccacgagggcuccgagcagaaccaguggcacaugcagcugaccaaccucaacgggaccccguucgaccccaccgaggacauccccgcgccccugggcacgccggacuucaagggggagaucuucggcuucaucagccagcgcaacgcccagaacgaccccggccagucccagcccgccaaccgggcccacgacgccguggugagcacccgcgcgcccaaguucaccccgaagcuggggagcgucaugaucggcaccugggugaacuccgacaucgagaaccagcccagcaaguucacgcccguggggcucaacuccagcgagaacuucaagcagugggagcugcccgacuacuccggcguccugacccucaacauggggcuggccccgguggugcaccccaccuaccccggcgagcagauccuguucuuccggagcuacaucccccucaagggcgggcacggcaacccggccaucgacugccugcugccccaggaguggauccagcacuucuaccaggaguccgcccccagccagaccgacgucgcccuccugaaccccgacacggggcgcgugcuguucgaggcgaagcuccaccggcagggcuacaucaccaucgccaaguccggggacggcccgaucguggucccgcccaacggcuacuuccgcuucgacagcugggugaaccaguucuacucccuggcccccauggggaacggcaacgggcggcgccgcgugcaguga

SEQ ID NO: 10281 - RNA, 1632 nt, Artificial Sequence
  derived and/or modified sequence opt1 from capsid__Norovirus__ACY00638
augaugauggccagcaaggacgcccccaccaacauggacggcaccuccggggcgggccagcuggugccggaggucagcacggccgagcccaucuccauggagcccguggccggggccgccaccgcggccgccaccgccggccaggugaacaugaucgaccccuggaucaugagcaacuacguccaggcgccgcagggggaguucaccaucucccccaacaacacgcccggcgacauccucuucgaccugcagcugggcccccaccucaacccguuccugagccaccuggcccagauguacaacgggugggugggcaacaugaaggugcgcguccuccuggccgggaacgccuucaccgccggcaagaucaucaucuccugcgugccgcccggguucgcggcccagaacgugagcaucgcccaggccaccauguucccccacgucaucgccgacgugcgggugcuggagcccaucgaggucccccucgaggacgugcgcaacgugcuguuccacaacaacgacuccacccccacgaugcggcugaucugcaugcucuacacgccccugcgcgcgagcggcuccagcuccggcaccgacccguucgucaucgccgggcgggugcugaccugccccagccccgacuucaacuuccucuuccuggugcccccgaacgucgagcagaagaccaagcccuucuccgugcccgaccugccccucaacgugcugagcaacucccgcgucccgagccugaucaaguccaugauggugagccaggaccacggccagauggugcaguuccagaacgggcgggucacccucgacggccagcugcagggcaccacccccacgagcgccucccagcugugcaagauccgcgggaccguguaccacgccaccggcgggcagggccucaaccugaccgagaucgacgggacgcccuaccacgccuucgagagccccgcgccgaucggcuuccccgaccugggcgagugcgacuggcacaucaacgccucccccgccaacgccuucaccgacgggagcaucauccaccggaucgacgucgugcaggacccgaccuucgcgccccaccucggcaccauccacuacacgaacgccaacuacgacgccaacgugucccugaucugcagccuggaguggcucuccccgcccagcgggggcgcccugaaggccaaccccugggcgaucccccgcuacggguccacccugaccgaggccgcccagcucgccccgcccaucuacccgcccggcuucggcgaggccaucgucuucuucaugagcgacuuccccaucgcgaacggguccgacggccugagcgugcccugcaccaucccccaggaguucgugacgcacuucgucaacgagcaggcccccacccgcggggaggccgcccugcuccacuacguggaccccgacacccaccggaaccugggcgaguucaagcuguaccccgagggguucaugaccugcgugccgaacuccagcggcuccggcccccagacgcuccccaucaacggggucuucaccuucaucagcugggugucccgguucuaccagcugaagcccgugggcaccaccgggccgguccgccggcugggcauccgccggagcuga

SEQ ID NO: 10282 - RNA, 1635 nt, Artificial Sequence
  derived and/or modified sequence opt1 from capsid__Norovirus__ACY00641
augaugauggccagcaaggacgcccccaccaacauggacggcaccuccggggcgggccagcuggugccggaggccaacacggccgagcccaucagcauggaccccgucgccggggccgcgaccgccguggccaccgccggccagaucaacaugaucgaccccuggaucauguccaacuucgugcaggcgccgcagggggaguucaccgucagccccaacaacacgcccggcgacguccucuucgaccugcagcugggcccccagcucaacccguuccuggcccaccuggcccagauguacaacgggugggugggcaacaugcgcgugaaggugcuccuggccgggaacgccuucaccgcgggcaagaucaucaucuccugcaucccgcccggguucaccagccagaacaucuccaucgcccagaugaccauguucccccacgugaucgccgacguccgggugcuggagcccaucgagaucccccucgaggacgugcgcaacguccuguuccacacgaacgacaaccggcccaccaugcgccuggugugcaugcucuacacgccccugcgggccaacggcagcuccagcggcaccgacccguucgugaucgccgggcgcguccugaccugccccgacuccaacuucagcuuccucuuccuggugccgcccaacguggagcagaagacccggcccuucuccguccccaacaucccccugaacacccucagcaacucccgcgugcccagccugaucaaguccaugaccaucagccgggaccagaaccagaucauccaguuccagaacggccgcgugacgcuggacgggcagcuccagggcaccaccccgaccuccgucagccagcugugcaagauccggggcacgaccuaccacgcgaccgggggcagcgggaucaaccugaccgagcucaacggcgagcccuaccacgccuucgagucccccgcccccaucggguucccggaccugggcggcugcgacuggcaccugacggccacccccacccaggccuucaacgacggggcgaagguggugcgccucagcgucacccagggcgccgccuucgcgccccaccuggggacgauccacuacaccaccaccgacacggacuacaacccgaacaccuccaucaucugcacccuggacuggcucagccagaccacgggccaguccaacguggaccccuggcagauccccaccuacgggagcacccugaccgaggccgcccagcuggcgcccccgaucuucccgcccggcuucggcgagacccucgucuucuuccuguccgacuuccccaucagcaacgggaagaacggccuguccgugcccugcacgcucccccaggaguucgugacccacuucgucaacgagcaggcccccauccgcggggaggccgcccugcugcacuacgccgaccccgacacccaccggaaccucggcgaguucaagcuguacccggagggguucaugaccugcgugcccaacacgagcggcggcgggccccagacccugcccaucaacggcguguucgucuucguguccugggugagccgguucuaccagcucaagccggucgggaccgccggcgccgcccgccggcugggcauccgccgguccuga

SEQ ID NO: 10283 - RNA, 1635 nt, Artificial Sequence
  derived and/or modified sequence opt1 from capsid__Norovirus__ACY00645
augaugauggccagcaaggacgcccccaccaacauggacggcaccuccggggcgggccagcuggugccggaggccaacacggccgagcccaucagcauggaccccgucgccggggccgcgaccgccguggccaccgccggccagaucaacaugaucgaccccuggaucauguccaacuucgugcaggcgccgcagggggaguucaccgucagccccaacaacacgcccggcgacguccucuucgaccugcagcugggcccccagcucaacccguuccuggcccaccuggcccagauguacaacgggugggugggcaacaugcgcgugaaggugcuccuggccgggaacgccuucaccgcgggcaagaucaucaucuccugcaucccgcccggguucaccagccagaacaucuccaucgcccagaugaccauguucccccacgugaucgccgacguccgggugcuggagcccaucgagaucccccucgaggacgugcgcaacguccuguuccacacgaacgacaaccggcccaccaugcgccuggugugcaugcucuacacgccccugcgggccaacggcagcuccagcggcaccgacccguucgugaucgccgggcgcguccugaccugccccgacuccaacuucagcuuccucuuccuggugccgcccaacguggagcagaagacccggcccuucuccguccccaacaucccccugaacacccucagcaacucccgcgugcccagccugaucaaguccaugaccaucagccgggaccagaaccagaucauccaguuccagaacggccgcgugacgcuggacgggcagcuccagggcaccaccccgaccuccgucagccagcugugcaagauccggggcacgaccuaccacgcgaccgggggcagcgggaucaaccugaccgagcucaacggcgagcccuaccacgccuucgagucccccgcccccaucggguucccggaccugggcggcugcgacuggcaccugacggccacccccacccaggccuucaacgacggggcgaagguggugcgccucagcgucacccagggcgccgccuucgcgccccaccuggggacgauccacuacaccaccaccgacacggacuacaacccgaacaccuccaucaucugcacccuggacuggcucagccagaccacgggccaguccaacguggaccccuggcagauccccaccuacgggagcgcccugaccgaggccgcccagcuggcgcccccgaucuucccgcccggcuucggcgagacccucgucuucuuccuguccgacuuccccaucagcaacgggaagaacggccuguccgugcccugcacccucccccaggaguucgugacgcacuucgucaacgagcaggcccccauccgcggggaggccgcccugcugcacuacguggaccccgacacccaccggaaccucggcgaguucaagcuguacccggagggguucaugaccugcgugcccaacaccagcggcggcgggccccagacgcugcccaucaacggcgucuucguguucguguccugggucagccgguucuaccagcucaagccgguggggaccgccggcgccgcccgccggcugggcauccgccgguccuga

SEQ ID NO: 10284 - RNA, 1635 nt, Artificial Sequence
  derived and/or modified sequence opt1 from capsid__Norovirus__ACY00647
augaugauggccagcaaggacgcccccaccaacauggacggcaccuccggggcgggccagcuggugccggaggccaacacggccgagcccaucagcauggagcccgucgccggggccgcgaccgccgccgccaccgcgggccaggugaacaugaucgaccccuggaucaugaacaacuacgugcaggccccgcagggggaguucaccaucucccccaacaacacgcccggcgacauccucuucgaccugcagcugggcccccaccucaacccguuccugagccaccuggcccagauguacaacgggugggucggcaacaugaaggugaaggugcuccuggccgggaacgccuucaccgcgggcaagaucaucaucuccugcaucccgcccggguucgccgcccagaacaucagcaucgcccaggccaccauguucccccacgucaucgcggacgugcgcgugcuggagcccaucgaggucccccucgaggacgugcggaacgugcuguuccacaacaacgacaacucccccaccaugcgccuggucugcaugcucuacacgccccugcgggccagcggcuccagcuccggcaccgacccguucgugaucgccgggcgcgugcugaccugccccagccccgacuucuccuuccucuuccuggugcccccgaacgucgagcagaagaccaagcccuucagcgugcccaaccugccccucaacacgcuguccaacagccgggucccgucccugaucaacgccaugaugaucagccgcgaccacggccagauggugcaguuccagaacgggcgggugacccucgacggccagcugcagggcaccacccccacgucccugagccagcucugcaagauccgcgggaaggucuuccacgccagcggcgggaacggccugaaccugaccgagcucgacggguccgcguaccacgccuucgagagccccgcccccaucggcuucccggacaucggcgagugcgacuggcacaugaacgccaccgccaccuccaacuucacggggagcaacgacgaguaccagauccuggugaagcaggaguccaccuucgcgccccaccugggccacgugcaggccgacagccucuccgccgacgccaacaccgaccugauggucagccuguccuggaucagccccguguccgaccagcaccggcgcgacgucgacccgugggugaucccccgguacgggagcucccucaccgaggcggcccagcuggccccgcccaucuacccgcccggcuucggggaggccaucguguucuucaugagcgacuuccccgucguguccggcgugaacggcaugcgcauccccugcacgcugccccaggaguacgucgcccacuucgugaacgagcaggcgcccacccgcggggaggccgcccuccugcacuacguggaccccgacacccaccggaaccugggcgaguucaagauguaccccgagggguucaugaccugcgucccgaacagcuccggcagcgggccccagacgcuccccaucaacggcgugcugaccuucguguccugggucagccgguucuaccagcugaagcccgugggcaccgccgggccggcccgccggcucggcauccgccggagcuga

SEQ ID NO: 10285 - RNA, 1668 nt, Artificial Sequence
  derived and/or modified sequence opt1 from capsid__Norovirus__ACY00650
augcgcauggccagcuccgacgcccccgugagcggcaccgacggggcggccggccuggucccggagucccagcaggaggugcucccccuggagcccguggccgggguccagcuggccgcccccguggcgggccagagcaacaucaucgacccguggauccggaugaacuucgugcaggcccccgccggggaguucaccgucagcccccgcgacgcccccggcgaggugcucaucgaccuggagcugggcccggagcucaaccccuaccugaaccaccuggcgcggauguacaacggguacgugggcgggauggaggucgagguggugcucgccggcaacgccuucacggccgggaagauccuguucgccgcggucccgcccuccuuccccacccacggcaucuccgccgcccaggccaccaugcugccccacgugaucguggacguccgccagcucgagcccgugcggcugccccugccggacgugcgcaacgucauguuccacuucugccaggagaacaaggagccccggaugcgcaucguggccauccucuacacgccccugcgggcgaacggcgccggggacgacguguucaccgucagcugccgcgugcugacccggcccuccccggacuucgacuucaucuuccucgugcugcccagcgucgaguccaagcugaagcaguucacccuccccaaccugcagcccaacgagaugaccaacagccgcuucccgacgggcaucauccagcuguacaccucccccaacaccaaccucgugguccaguuccagaacgggcggugccugcuggacggcacccuccugggcacgacccccgugcgcgccgccgacaucugcagcuuccgcggggugaccuccaccgaggucgacgccacggacagcccccggguggcgggcucccaccggaucauggugcagcugaaggagccggacggggaggaguucagccccaccggccccaacccggcccccgucgggacccccgacuuccaggccgccaucuucggcacccucucccagcgcaacacgggcggggccggccagaacagcaaccgggcgcgcuucgccuacuucuacacccggaaccccaccuucgccccggggaucggcaccgugguguucagcuucgacacgaccgacuuccagaaccgccagcccaccaaguucucccccagcggggucuucgacgacgacuccagcgagcccuucaaccaguucucccugccguacuacaacggcagccugggcgccguggacgcggggaagcucgccccgcccguggcccccaacuaccccggcgagcagauccuguacuuccgcgggaacauccccuucaagggcggguacggcgagggcgagaucgacucccugcucccccaggaguggaucacccacuucuacgccgagcaggcccccacgcagggggacgcggcccugcugcgguacuacaacccggacaccggccgcguccucuucgagugcaagcugcaccgggagggguucaucaccaucaacuacaccggcagcaacgcccuggccgugcccgugaacggcgucuuccgcuucgaggggugggugaacaaguucuacacgcucacccccaugggcaacgggaacggccggcgcgggcggcgccgggagcuguga

SEQ ID NO: 10286 - RNA, 1617 nt, Artificial Sequence
  derived and/or modified sequence opt1 from capsid__Norovirus__ACY00656
auggccagcaacgacgccgcgcccuccaacgacggcgccgccgggcuggugcccgaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggagauccuccugaaccuggagcucggccccgagcugaacccguaccuggcccaccucucccgcauguacaacggcuacgccgggggcguggagguccaggugcugcuggccgggaacgccuucaccgccggcaagcucguguucgcggccaucccgccccacuuccccgucgacaaccugagccccgggcagaucaccauguucccccacgugaucaucgacgugcggacccuggagcccguccuccugccccugccggacgugcgcaacaacuucuuccacuacaaccagcaguccgaccagcggaugcgccucguggccaugcuguacacgccccugcggagcaacggcuccggcgacgacgucuucaccgugagcugccgcgugcucacccggcccucccccgacuucgacuucaacuaccuggucccgcccaccguggagagcaagacgaagcccuucuccgugcccguccugacccucaacgagcugaccaacagccgcuucccggugcccaucgacgccauguacaccucccccaacgacagcaucgugguccagccccagaacgggcgggccacgaucgacggcgagcugcucgggaccacccagcugaucccguccggcaucugcagcuuccgcggcaagaucaccacgcaccuggcggacgaccggcaccucuggaacauccagguguccaaccugaacgggacccccuucgaccccaccgacgacgucccggcgccccugggcaugcccgacuucagcgggcagaucuucggcguggugagccagcgcgacaccgggacgaaccccgccaaccgggcccacgacgccguccucgccaccuacuccgccaaguacaccccgaagcugggcagcgugcagaucggcaccugggacacggaggaccugcucgagcgccagcccgugaaguucacccccgucgggcugaacgagaucggccaggacaagcacuucgaccagugggugcugcccaacuacuccggggcccucggccugaacaugcaccuggccccggccgugagcccccucuuccccggggagcggcugcuguucuuccgcuccuacaucccccucaagggcggccacggggacccguucaucgacugccuggucccccaggaguggauccagcacuucuaccaggagagcgcgcccgcccaguccagcguggcccugcuccgguacgugaaccccgacaccggccgcacccuguucgaggccaagcugcacaagggcggguucaucacggucuccagcaccgagaaccggccggugaucgugccgcccaacggguacuuccgcuucgacuccugggucaaccaguucuacagccuggcgcccaugggcaccggcaacgggcgccggcgcaugcaguga

SEQ ID NO: 10287 - RNA, 1623 nt, Artificial Sequence
  derived and/or modified sequence opt1 from capsid__Norovirus__ADK47170
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccugucccgcauguacaacggcuacgccgggggcuucgaggugcaggucauccucgccgggaacgccuucacggccggcaagaucaucuucgcggccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgcguucgucgugcagccccagaacgggcgcugcacgaccgacggcguccuccuggggaccacccagcucagccccgugaacaucugcacguuccggggcgacgugacccacaucccgggcucccgcaacuacaccaugaaccuggccagccagaacuggaacagcuacgaccccaccgccgagauccccgcgccccuggggacgccggacuucgucggcaagauccagggggugcucacccagaccacccggacgaacggcuccacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccugcccuccuacagcgggcggaacauccacaacgugcaccucgcccccgccguggcccccaccuucccgggcgagcagcugcuguucuuccgcuccaccaugcccgggugcagcggcuaccccaacauggaccucgacugccugcugccccaggaguggguccaguacuucuaccaggaggcggccccggcccaguccgacguggcccuccugcgguucgugaaccccgacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgggcccucuga

SEQ ID NO: 10288 - RNA, 1644 nt, Artificial Sequence
  derived and/or modified sequence opt1 from capsid__Norovirus__ADR30514
augaagauggccagcaacgacgccgcgcccuccaacgacggcgccgccgaccuggugccggaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggagaacaucuccgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggcccccaucgacaugcuguacaccgaccccaacgagggcaucguggugcagccccagaacggccgcugcacccuggacgggacgcuccagggcaccacccagcuggucccgacccagaucugcgccuuccgggggacgcugaucggccagaccucccgcagcuccgacagcaccgacuccgcgccccggcgccgggaccacccccuccacgugcagcugaagaaccuggacggcacccaguacgacccgacggacgagguccccgccgugcucggggccaucgacuucaagggcaccguguucggggucgccagccagcgcgacguguccggccagcaggucggggccacccgggcccacgaggugcacaucaacaccacggacccccgcuacacccccaagcugggcagcauccugaugcacagcgaguccgacgacuucgugaccggccagccggugcgguucacccccaucgggaugggcgacaacgacuggcaccagugggagcuccccgacuacagcgggcaccugacgcugaacaugucccucgcccccgcggucgccccggccuuccccggcgagcgcauccuguucuuccgcagcaucgugcccuccgccgggggcuacggcagcgggcagaucgacugccugaucccccaggagugggugcagcacuucuaccaggaggcggccccgucccagagcgccgucgcccucauccgguacgugaaccccgacaccggccgcaacaucuucgaggccaagcugcaccgggagggguucaucaccguggcgaacuccggcaacaaccccaucgucgugcccccgaacggguacuuccgcuucgaggccugggugaaccaguucuacacccugacgcccaugggcaccggccaggggcggcgccggaaccaguga

SEQ ID NO: 10289 - RNA, 1623 nt, Artificial Sequence
  derived and/or modified sequence opt1 from capsid__Norovirus__ADR78255
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcgccuucgugguccagccccagaacgggcgcugcacgaccgacggcgugcuccuggggaccacccagcucucccccgucaacaucugcacguuccggggcgacgugacccacaucgccggcagccgcaacuacaccaugaaccuggccacccagaacuggaacuccuacgacccgacggaggagauccccgcgccccuggggacccccgacuucgugggcaagauccaggggguccucacccagaccacgcgggccgacggcagcacccgcgggcacaaggccaccguguacaccggcagcgccgacuucuccccgaagcugggccgggugcaguucgccacggacaccgacaacgacuucgacgccaaccagaacaccaaguucacccccgucggggugauccaggacggcaacacggcgcaccgcaacgagccccagcagugggugcugcccagcuacuccgggcggaacagccacaacguccaccucgccccggccguggcccccaccuuccccggcgagcagcugcuguucuuccgcuccaccaugcccgggugcagcggcuacccgaacauggaccucgacugccugcugccccaggagugggugcaguacuucuaccaggaggcggcccccgcccaguccgacgucgcccuccugcgguucgugaaccccgacaccggccgcgugcuguucgagugcaagcuccacaagagcggguacgucacgguggcccacaccggccagcacgaccuggugaucccgcccaacggguacuuccgguucgacuccugggucaaccaguucuacacccuggcgcccaugggcaacgggaccggccgccgccgggcccucuga

SEQ ID NO: 10290 - RNA, 1623 nt, Artificial Sequence
  derived and/or modified sequence opt1 from capsid__Norovirus__ADR78259
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccugucccgcauguacaacggcuacgccgggggcuucgaggugcaggucauccucgccgggaacgccuucacggccggcaagaucaucuucgcggccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgcguucgucgugcagccccagaacgggcgcugcacgaccgacggcguccuccuggggaccacccagcucagccccgugaacaucugcacguuccggggcgacgugacccacaucccgggcucccgcaacuacaccaugaaccuggccagccagaacuggaacagcuacgaccccaccgaggagauccccgcgccccuggggacgccggacuucgucggcaagauccagggggugcucacccagaccacccggacgaacggcuccacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccugcccuccuacagcgggcggaacauccacaacgugcaccucgcccccgccguggcccccaccuucccgggcgagcagcugcuguucuuccgcuccaccaugcccgggugcagcggcuaccccaacauggaccucgacugccugcugccccaggaguggguccaguacuucuaccaggaggccgcgccggcccaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacccuggcgcccaugggcaacgggacgggccgccgccgggcccucuga

SEQ ID NO: 10291 - RNA, 1623 nt, Artificial Sequence
  derived and/or modified sequence opt1 from capsid__Norovirus__ADR78262
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccugucccgcauguacaacggcuacgccgggggcuucgaggugcaggucauccucgccgggaacgccuucacggccggcaagaucaucuucgcggccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgcguucgucgugcagccccagaacgggcgcugcacgaccgacggcguccuccuggggaccacccagcucagccccgugaacaucugcacguuccggggcgacgugacccacaucccgggcucccgcaacuacaccaugaaccuggccagccagaacuggaacagcuacgaccccaccgaggagauccccgcgccccuggggacgccggacuucgucggcaagauccagggggugcucacccagaccacccggacgaacggcuccacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccugcccuccuacagcgggcggaacacccacaacgugcaccucgcccccgccguggcccccaccuucccgggcgagcagcugcuguucuuccgcuccaccaugcccgggugcagcggcuaccccaacauggaccucgacugccugcugccccaggaguggguccaguacuucuaccaggaggccgcgccggcccaguccgacguggcccuccugcgguucgugaaccccgacaccggccgcguccuguucgagugcaagcuccacaagagcggguacgugaccguggcccacaccggccagcacgaccuggucaucccgcccaacggguacuuccgguucgacuccugggugaaccaguucuacacgcuggcgcccaugggcaacgggaccggccgccgccgggcccucuga

SEQ ID NO: 10292 - RNA, 1623 nt, Artificial Sequence
  derived and/or modified sequence opt1 from capsid__Norovirus__ADR78266
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccugucccgcauguacaacggcuacgccgggggcuucgaggugcaggucauccucgccgggaacgccuucacggccggcaagaucaucuucgcggccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgcguucgucgugcagccccagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgacccgaccgaggagauccccgcgccccuggggacgcccgacuucgucggcaagauccagggggugcucacccagaccacccggacgaacggcagcacccgcgggcacaaggccaccguguacaccggcuccgccgacuucagcccgaagcugggccggguccaguucgccacggacaccgacaacgacuucgagaccaaccagaacaccaaguucacgcccgugggggugauccaggacggcuccaccacgccccgcaacgagccccagcaguggguccugccgagcuacuccgggcggaacauccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggccgcgcccgcccagagcgacguggcccuccugcgguucgugaacccggacaccggccgcguccuguucgagugcaagcuccacaaguccggguacgugaccguggcccacaccggccagcacgaccuggucaucccgcccaacggguacuuccgguucgacagcugggugaaccaguucuacacccuggcgcccaugggcaacgggacgggccgccgccgggcccucuga

SEQ ID NO: 10293 - RNA, 1623 nt, Artificial Sequence; identical to SEQ ID NO: 10290
  derived and/or modified sequence opt1 from capsid__Norovirus__ADR78268

SEQ ID NO: 10294 - RNA, 1569 nt, Artificial Sequence
  derived and/or modified sequence opt1 from capsid__Norovirus__AFQ00093
augaagaugaccgaccgcgacaucguggacagcgcccccgcccugggccagguccucccgcccgagguggaggcguccgugcccgucgagcccaccgccggggccccgguggccgccagcacggcgggccgggugaaccccaucgaccccuggaucuucgccaacuucguccaggcgccccagggggaguucaccaucuccccgaacaacaaccccggcgagauccuguucgagcuggagcucgggcccgaccugaaccccuaccuggcccaccuccgccggauguacaacggcuggaccggcagcaugcgcgugcgggugcugcuggccgggaacgccuucuccgccggcaaggucgugguguucugcgucccgcccggguucgacaccagcuaccucacgcccucccaggccacccaguucccccacgugcugaucgacgugcgcgccccggagcccgucgacaugccccuggaggacgugcggaacauccucuuccaccagggccccgacagccgcaugcggcugauggggaugcuguacaccccgcuccgcgcgaacuccggcgccgaccccuucguggucaccggccgggugcugacgugccccagccccaacuucuccuucuucuuccuggugccgcccaccgucgaggagcgcgagccgcccuucacccuccccaaccugcccgugaacagccugucccacagccgggugauggagcccaucgcccagaugauguccagccgcuccuucccggccagcguccaguuccagaacgggcggugcacccucuccggcgaccugcuggggacgacccccagcagccccgccgaccucggcgcguucgugggccugaucgccgagcccgggucccgcgucguggagcugagccagccgaaccaggaggacuuccacgccggcuccgcccccgcccccuucggguuccccgacuucagcgagugcuccgugaccuucgucguggcgagcgccaccacggugggcgagcggaccgucaacgcccgcaacccgcagaacuucacccccgcccucgggcacaucaccuucgacgaggaggcccccgcggaccuguuccgggcccgcuuccggaaccugugggagcccacggagcacuccuucuggcgcaucccggacuaccgcgccgacgugcucggcagcgacuucgcccccuccgugagcgcgcccggcgucggggagacccugcuguucuucaugugcaacgugccccggcucaacggcgccaacccgaaccccugccccugccugcugccccaggaguggaucacccacuucguguccgagcgcgccgcccuccagagcgacgucgcccugcugaacuacgugaacccgaacaccgggcggguccucuucgaggcgaagcuguacgccaacggcuuccugacggugaaccucggggccuccgaccaggccauccugcccguggacggcaucuucaaguucgugagcugggucuccuucuacuaccagcugcgccccgugggcaacaucagcguggggcggcgccucccccggcuggacggcuucuga

SEQ ID NO: 10295 - RNA, 1629 nt, Artificial Sequence
  derived and/or modified sequence opt1 from capsid__Norovirus__BAI52939
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgcggggaacgccuucaccgccggcaagcugguguucgccgcggucccgccccacuuccccaucgagaaccugagcccccagcagaucaccauguucccccacgugaucaucgacgugcggacgcucgagcccguccugcugccccucccggacgugcgcaacaacuucuuccacuacaaccagaaggacgaccccaagaugcggaucguggccaugcuguacacgccccugcgcuccaacgggagcggcgacgacgucuucaccguguccugccgggugcucacccgccccagcccggacuucgacuucaccuaccuggucccgcccaccguggaguccaagaccaagcccuucacccugcccauccucacgcugggcgagcugagcaacucccgguuccccgccagcaucgaccagauguacaccucccccaacgaggugaucagcguccagugccagaacgggcgcugcacccucgacggcgagcugcaggggaccacgcagcugcaggucuccggcaucugcgccuucaagggcgaggugaccgcccaccuccacgacaacgaccaccuguacaacaucaccaucaccaaccugaacgggagccccuucgacccguccgaggacauccccgcgccccucggcaugccggacuuccaggggcggguguucggcaucaucagccagcgcgaccggcacaacucccccgggcacaacgagcccgccaaccgcggccacgacgccgugguccccacguacaccgcccaguacaccccgaagcugggccagauccagaucgggaccuggcagacggacgaccugaccgugagccagcccgugaaguucacccccgucggccucaacgacaccgagcacuucaaccaguggguggugccccgguacgccggggcgcugaaccugaacacgaaccucgccccgagcgucgcccccguguuccccggcgagcgccugcuguucuuccgguccuacaucccccucaagggcggguacggcaacccggccaucgacugccugcugccccaggagugggugcagcacuucuaccaggaggcggcccccagcauguccgaggucgcccucgugcgcugcaucaaccccgacaccgggcgggcccuguucgaggccaagcugcaccgcgcgggcuucaugaccgugagcuccaacaccagcgccccggucguggugcccgccaacggguacuuccgguucgacuccugggucaaccaguucuacagccucgcccccaugggcacggggaacggccgccgccgggugcaguga

SEQ ID NO: 10296 - RNA, 1623 nt, Artificial Sequence
  derived and/or modified sequence opt1 from capsid__Norovirus__BAI52940
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugggccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggacguguucaccguguccugccgcguccugacccggcccagcccggacuucgacuucaucuuccucgugccgcccaccguggagucccgcaccaagcccuucacgguccccauccugaccguggaggagaugaccaacagccgguuccccaucccccuggagaagcuguucaccgggcccuccagcgccuucgugguccagccgcagaacggccgcugcacgaccgacggggugcugcugggcaccacccagcucucccccgucaacaucugcacguuccggggcgacgugacccgcaucgccgggagccggaacuacaccaugaaccuggccucccugaacuggaacaacuacgaccccaccgaggagaucccggcgccccucggcacgcccgacuucguggggaagauccagggcguccugacccagaccaccaagggggacggcagcacgcgcggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccggaacgagccccagcagugggugcuccccuccuacagcggccgcaacgucccgaacgugcaccuggcccccgccguggcgcccaccuuccccggcgagcagcuccucuucuuccgguccacgaugccggggugcagcggcuaccccaacauggaccuggacugccugcucccccaggaguggguccagcacuucuaccaggaggccgcccccgcccaguccgacguggcgcugcugcgcuucgugaacccggacaccgggcggguccucuucgagugcaagcugcacaagagcggcuacgugaccguggcccacaccgggcagcacgaccuggucaucccgcccaacggcuacuuccgcuucgacuccugggugaaccaguucuacacccucgcccccaugggcaacgggacgggccggcgccgcgcccuguga

SEQ ID NO: 10297 - RNA, 1623 nt, Artificial Sequence
  derived and/or modified sequence opt1 from capsid__Norovirus__BAQ20801
augaagauggccagcuccgacgccaaccccagcgacggcuccgcggccaaccuggugcccgaggucaacaacgaggacauggcccucgagcccguggugggggccgccaucgcggcccccgucgccggccagcagaacgugaucgaccccuggauccgcaacaacuucgugcaggcccccgggggcgaguucaccgucagcccccggaacgcgcccggggagauccugugguccgcgccccugggcccggaccucaaccccuaccugagccaccuggcccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggcgaacaacgccggcgacgacguguucaccgucagcugccgcgugcugacccggccgucccccgacuucgacuucaucuuccucgugccgcccaccgucgagagccgcaccaagcccuucuccgugcccgugcugacggucgaggagaugaccaacagccgguuccccaucccccuggagaagcuguucaccggcccguccagcgccuucgugguccagccccagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggaacaacuacgacccgaccgaggagauccccgcgccccuggggacgcccgacuucgugggcaagauccagggggugcucacccagaccacccggacggacggcagcacccgcgggcacaaggccaccgucuacaccggcagcgccaacuucuccccgaagcugggccgggugcaguucgagacggacaccgaccacgacuucgaggugaaccagaacaccaaguucacccccgucggggugauccaggacggcgggacgacccaccgcaacgagccccagcagugggugcugcccagcuacuccggccggaacaccccgaacguccaccucgcccccgccguggcccccaccuuccccggggagcagcugcuguucuuccgcagcacgaugccgggcugcuccggcuaccccaacauggaccucgacugccugcugccccaggagugggugcaguacuucuaccaggaggcggcccccgcccagagcgacgucgcccuccugcgguucgugaacccggacaccgggcgcgugcuguucgagugcaagcuccacaaguccggcuacgucaccguggcgcacaccgggcagcacgaccuggugaucccgcccaacggcuacuuccgguucgacagcugggucaaccaguucuacacccuggcccccauggggaacggcacgggccgccgccgggcccucuga

SEQ ID NO: 10298 - RNA, 1623 nt, Artificial Sequence
  derived and/or modified sequence opt1 from capsid__Norovirus__BAQ20803
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccaacuucuccccgaagcugggccgggugcaguucgagacggacaccgaccacgacuucgaggucaaccagaacaccaaguucacccccgugggggugauccaggacggcagcacgacccaccgcaacgagccccagcaguggguccugcccuccuacagcgggcggaacaccccgaacgugcaccucgcccccgccguggcccccaccuuccccggcgagcagcugcuguucuuccgcuccacgaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgggcccucuga

SEQ ID NO: 10299 - RNA, 1623 nt, Artificial Sequence
  derived and/or modified sequence opt1 from capsid__Norovirus__BAQ20805
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccggcgagagccgcaccaagcccuucuccgugcccgugcugacggucgaggagaugaccaacagccgguuccccaucccccuggagaagcuguucaccgggccguccagcgccuucgugguccagccccagaacggccgcugcaccacggacggggugcugcugggcaccacccagcucucccccgugaacaucugcaccuuccggggcgacgucacgcacaccaccgggagccacaacuacaccaugaaccuggccucccagaacuggaacaacuacgacccgacggaggagauccccgcgccccugggcacccccgacuucguggggaagauccagggcaugcucacccagaccacgcgcaccgacgggagcacccggggccacaaggccaccguguacacgggcagcgccgacuucgccccgaagcuggggcgcguccaguucggcaccgacaccgaccacgaccuggaggccaaccagaacaccaaguucacgcccgugggggugauccaggacggcuccaccacccaccggaacgagccccagcaguggguccuccccagcuacuccgggcgcaacaccccgaacgugcaccuggcccccgcgguggcccccacguuccccggcgagcagcuccucuucuuccggagcaccaugccgggcugcuccggguaccccaacauggaccuggacugccugcucccccaggaguggguccaguacuucuaccaggaggccgcccccgcgcagagcgacguggcccugcugcgcuucgugaacccggacaccggccggguccucuucgagugcaagcugcacaaguccggguacgugaccguggcccacaccggccagcacgaccuggucaucccgcccaacggguacuuccgcuucgacagcugggugaaccaguucuacacgcucgcccccaugggcaacggcaccgggcggcgccgcgcccuguga

SEQ ID NO: 10300 - RNA, 1647 nt, Artificial Sequence
  derived and/or modified sequence opt1 from capsid_protein__Norovirus__AAB06271
augaagauggccagcaaccgcgccgcgcccuccaacgacggcgccgccugccuggugccggagaucaacaacgaggccauggcccucgagcccgucgcgggggccgccaucgccgcgccccugaccggccagcagaacaucaucgaccccuggaucaugaacaacuucgugcaggcccccgggggcgaguucaccgugagcccccggaacucccccggggagguccugcucaaccuggagcugggccccgagaucaacccguaccucgcccaccuggcccgcauguacaacggcuacgccgggggcuucgagguccagguggugcuggcggggaacgccuucacggccgccaagaucaucuucgccgcgaucccgcccaacuuccccaucgacaaccucagcgccgcccagaucaccaugugcccgcacgugaucguggacguccggcagcuggagcccaucaaccugcccaugcccgacgugcgcaacaacuucuuccacuacaaccagggcuccgacagccggcuccgccugaucgccaugcuguacaccccgcuccgggccaacaacuccggggacgacguguucaccgucagcugccgcgugcugacgcggcccucccccgacuuccuguucaacuuccucgugcccccgaccgucgagagcaagaccaagcccuucacccugcccauccugacgaucuccgagaugagcaacucccgcuuccccgugccgaucgacagccuccacaccucccccaccgagaacaucgugguccagugccagaacggccgggugacccuggacggcgagcugauggggacgacccagcuccugcccagccagaucugcgcguuccgcggcacccugaccggguccacgagccgggccuccgaccaggccgacacccccaccccgcgccucuucaaccaccacuggcacauccagcuggacaaccugaacggcacccccuacgaccccgccgaggacaucccggcgccccucggcacgcccgacuuccgggggaagguguucggcgucgccgggcagcgcaaccccgacagcaccacccgggcccacgaggccaagguggacaccacgagcggccgcuucaccccgaagcuggggucccuggagaucaccaccgagagcgacgaccucgaccugucccagcccacgaaguucacccccgugggcaucggcgucgacaaccgggccgaguuccagcaguggagccugcccgacuacuccgggcaguucacccacaacaugaaccucgcgccggccguggcccccaacuuccccggcgagcagcugcuguucuuccgcagccagcuccccuccagcgggggccgguccaacgggguccuggacugccuggugccgcaggagugggugcagcacuucuaccaggagagcgcccccgcccagacccaggucgcgcucgugcgcuacgugaaccccgacacgggccgcguccuguucgaggccaagcugcacaagcucggcuucaugaccguggccaagaacggggacucccccaucaccgugccgcccaacggcuacuuccgguucgagagcugggucaaccccuucuacacccuggcccccauggggacgggcaacgggcgccggcgcauccaguga

SEQ ID NO: 10301 - RNA, 1620 nt, Artificial Sequence
  derived and/or modified sequence opt1 from capsid_protein__Norovirus__AAK96218
augaagauggccagcuccgacgccaaccccagcgacggcuccaccgcgaaccuggugccggaggucaacaacgaggugauggcccucgagcccguggucggggccgccaucgccggccccguggcggggcagcagaacgugaucgaccccuggauccgcaacaacuucguccaggccccgggcggggaguucaccgugagccccacgaacgcccccggcgagauccugugguccgcgccccugggcccggaccucaaccccuaccugagccaccuggcccggauguacaacggguacgccggcggguucgaggugcaggucauccucgccggcaacgccuucaccgccgggaagaucaucuucgcggccgugccgcccaacuuccccaccgagggccugucccccagccaggugaccauguucccccacaucaucgucgacgugcgccagcuggagcccgugcucaucccgcugcccgacgcccggaacaacuucuaccacuacaaccaguccaacgacagcacgaucaagcugaucgccaugcucuacacgccccugcgcgccaacaacgcgggcgacgacgucuucaccguguccugccgggugcugacccgccccagcccggacuucgacuucaucuuccucgucccgcccaccguggagucccggaccaagcccuucaccgugcccauccugaccgucgaggagaugagcaacucccgcuuccccaucccccuggagaagcucuacacggggcccagcuccguguucgugguccagccgcagaacggccggugcaccaccgacggggugcugcugggcaccacgcagcucagcgccgucaacaucugcaccuuccgcggcgacgugacccacaucgccgggucccacgacuacaccaugaaccuggccagccagaacuggaacaacuacgaccccacggaggagauccccgccccgcugggcacccccgacuucguggggaagauccagggcaugcucacccagaccacgcgggaggacgggagcacccgcgcgaccaaggccaccgucuccacgggcagcgugcacuucacccccaagcugggcuccgugcaguacaccgccgacaccaacaacgacuuccagacggggcagaacaccaaguucacccccgucggcgugauccaggacgggagcaaccaccagaacgagccgcagcagugggugcugaccaacuacuccggccggacggggcacaacguccaccucgcccccgccguggcgcccaccuuccccggcgagcagcugcuguucuuccgcagcaccaugccgggcugcuccggguaccccaacaugaaccucgacugccugcugccccaggagugggugcagcacuucuaccaggaggccgcccccgcccagagcgacgucgcgcuccugcgguucgugaacccggacaccggccgcgugcuguucgagugcaagcuccacaaguccggguacgucaccguggcccacacgggcccccacgaccuggugaucccgcccaacggguacuuccgguucgaccccugggucaaccaguucuacacccuggcccccaugggcaacggcgccgggcgccggcgcgcccucuga

SEQ ID NO: 10302 - RNA, 1623 nt, Artificial Sequence
  derived and/or modified sequence opt1 from capsid_protein__Norovirus__AAR97648
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcauccaguucaacaccgacaccaacaacgacuucgagacggggcagaacaccaaguucacccccgugggcgucgugcaggacgggaacggcacccaccagaacgagccccagcagugggugcugcccuccuacagcggccggacggggcacaacguccaccucgccccggccguggcccccaccuuccccggcgagcagcugcuguucuuccgcagcaccaugcccgggugcuccggcuacccgaacaugaaccucgacugccugcugccccaggagugggugcagcacuucuaccaggaggccgcgcccgcccagagcgacgucgcccuccugcgguucgugaaccccgacaccgggcgcgugcuguucgagugcaagcuccacaaguccggcuacgucaccguggcccacacgggccagcacgaccuggugaucccgcccaacggguacuuccgguucgacagcugggucaaccaguucuacacccuggcgcccaugggcaacgggaccggccgccggcgcgcccucuga

SEQ ID NO: 10303 - RNA, 1623 nt, Artificial Sequence
  derived and/or modified sequence opt1 from capsid_protein__Norovirus__AAR97651
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucguguucgccgccgugccgcccaacuucccgaccgaggggcugagccccucccaggucaccauguucccccacaucaucguggacgugcggcagcuggagcccguccucaucccgcugcccgacgugcgcaacaacuucuaccacuacaaccagagcaacgaccccaccaucaagcugaucgccaugcucuacacgccccugcgggccaacaacgcgggcgaggacguguucaccgucuccugccgcgugcugacccggccgagccccgacuucgacuucaucuuccucgugccgcccaccgucgagucccgcacgaagcccuucaccgugcccauccugaccguggaggagaugaccaacagccgguuccccaucccccuggagaagcuguucacgggcccguccagcgccuucgucgugcagccccagaacgggcgcugcaccaccgacggcguccuccuggggaccacgcagcucucccccgugaacaucugcaccuuccggggcgacgugacccacaucgccggcacccacaacuacacgaugaaccuggccagccagaacuggaacaacuacgacccgaccgaggagauccccgcgccccuggggacccccgacuucgucggccgcauccaggggaugcucacccagacgacccggggcgacggguccacccgcggccacaaggccaccgugagcacgggcgacgugcacuucaccccgaagcugggguccauccaguucaacaccgacaccaacaacgacuucgagacgggccagaacaccaaguucacccccgucgggguggugcaggacggcaacgggacccaccagaacgagccccagcaguggguccugcccagcuacagcggccggacgggccacaacgugcaccucgccccggccguggcccccaccuuccccggggagcagcugcuguucuuccgcuccaccaugcccggcugcagcggguacccgaacaugaaccucgacugccugcugccccaggaguggguccagcacuucuaccaggaggccgcgcccgcccaguccgacguggcccuccugcgguucgugaaccccgacaccggccgcguccuguucgagugcaagcuccacaagagcggguacgugaccguggcccacacgggccagcacgaccuggucaucccgcccaacggcuacuuccgguucgacuccugggugaaccaguucuacacccuggcgcccauggggaacggcaccgggcgccggcgcgcccucuga

SEQ ID NO: 10304 - RNA, 1623 nt, Artificial Sequence; identical to SEQ ID NO: 10302
  derived and/or modified sequence opt1 from capsid_protein__Norovirus__AAR97654

SEQ ID NO: 10305 - RNA, 1623 nt, Artificial Sequence; identical to SEQ ID NO: 10302
  derived and/or modified sequence opt1 from capsid_protein__Norovirus__AAR97657

SEQ ID NO: 10306 - RNA, 1623 nt, Artificial Sequence; identical to SEQ ID NO: 10302
  derived and/or modified sequence opt1 from capsid_protein__Norovirus__AAR97660

SEQ ID NO: 10307 - RNA, 1623 nt, Artificial Sequence
  derived and/or modified sequence opt1 from capsid_protein__Norovirus__AAR97663
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagcugaacgaccccaccaucaagcucaucgccaugcuguacacgccccugcgggccaacaacgcgggcgaggacguguucaccgugagcugccgcguccucacccggccgucccccgacuucgacuucaucuuccuggugccgcccaccguggagagccgcacgaagcccuucaccguccccauccugaccguggaggagaugaccaacucccgguuccccaucccccucgagaagcuguucacgggcccgagcggggccuucgugguccagccccagaacggccgcugcaccaccgacggggugcugcucggcaccacgcagcugucccccgucaacaucugcaccuuccggggcgacgugacccacaucgccgggacccacaacuacacgaugaaccuggccagccagaacuggaacaacuacgacccgaccgaggagauccccgcgccccucggcacccccgacuucguggggcgcauccagggcaugcugacccagacgacccgcggggacggcuccacccggggccacaaggccaccgucagcacgggggacgugcacuucaccccgaagcugggcuccauccaguucaacaccgacaccaacaacgacuucgagacggggcagaacaccaaguucacccccgugggcgucgugcaggacgggaacggcacccaccagaacgagccccagcagugggugcuccccagcuacuccggccggacggggcacaacguccaccuggccccggccguggcccccaccuuccccggcgagcagcuccucuucuuccgcagcaccaugcccgggugcagcggcuacccgaacaugaaccuggacugccugcucccccaggagugggugcagcacuucuaccaggaggccgcgcccgcccaguccgacgucgcccugcugcgguucgugaaccccgacaccgggcgcgugcuguucgagugcaagcugcacaagagcggcuacgucaccguggcccacacgggccagcacgaccuggugaucccgcccaacggguacuuccgguucgacuccugggucaaccaguucuacacccucgcgcccaugggcaacgggaccggccgccggcgcgcccuguga

SEQ ID NO: 10308 - RNA, 1623 nt, Artificial Sequence
  derived and/or modified sequence opt1 from capsid_protein__Norovirus__AAS86774
augaagauggccagcaacgacgccgcgcccuccaacgacggcgccgccgggcuggugcccgaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggagauccuccugaaccuggagcucggccccgagcugaacccguaccuggcccaccucgcccgcauguacaacggcuacgccgggggcguggagguccaggugcugcuggccgggaacgccuucaccgcgggcaagcucguguucgccgccaucccgccccacuuccccgucgacaaccugucccccgggcagaucaccauguucccccacgugaucaucgacgugcggacccuggagcccguccuccugccccugccggacgugcgcaacaacuucuuccacuacaaccagcagagcgaccagcggaugcgccucguggccaugcuguacacgccccugcgguccaacggcagcggcgacgacgucuucaccguguccugccgcgugcucacccggcccagccccgacuucgacuucaacuaccuggucccgcccaccguggaguccaagacgaagcccuucagcgugcccguccugacccucaacgagcugaccaacucccgcuucccggugcccguggacgccauguacaccagccccaacgacuccaucgucgugcagccccagaacgggcgggcgacgaucgacggcgagcugcucgggaccacccagcugaucccgagcggcaucugcuccuuccgcggcaagaucaccacgcaccugagcgacgaccggcaccucuggaacauccaggucuccaaccugaacgggacccccuucgaccccaccgacgacgugccggcgccccugggcaugcccgacuucagcgggcagaucuucggcguggucagccagcgcgacaccgggacgaaccccgccaaccgggcccacgacgccgugcucgccaccuacuccgccaaguacaccccgaagcugggcagcgugcagaucggcaccugggacacggacgaccugcucgagcgccagcccgucaaguucacccccguggggcugaacgagaucggccaggacaagcacuucgaccagugggugcugcccaacuacuccggggcccucggccugaacaugcaccuggccccggccgucagcccccucuuccccggggagcggcugcuguucuuccgcuccuacaucccccucaagggcggccacggggacccguucaucgacugccuggugccccaggaguggauccagcacuucuaccaggagagcgcgcccgcccaguccagcguggcccugcuccgguacgucaaccccgacaccggccgcacccuguucgaggccaagcugcacaaggagggguucaucacgguguccagcaccgagaaccggccggugaucgucccgcccaacggcuacuuccgcuucgacuccugggugaaccaguucuacagccuggcgcccauggggaccggcaacggccgccggcgcaugcaguga

SEQ ID NO: 10309 - RNA, 1623 nt, Artificial Sequence
  derived and/or modified sequence opt1 from capsid_protein__Norovirus__AAS86777
augaagauggccagcaacgacgccgcgcccuccaacgacggcgccgccgggcuggugcccgaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggaggugcuccugaaccuggagcucggccccgagcugaacccguaccuggcccaccucgcccgcauguacaacggcuacgccgggggcgucgagguccaggugcugcuggccgggaacgccuucaccgcgggcaagcucguguucgccgccaucccgccccacuuccccguggacaaccugucccccgggcagaucaccauguucccccacgugaucaucgacguccggacccuggagcccgugcuccugccccugccggacgugcgcaacaacuucuuccacuacaaccagcagagcgaccagcggaugcgccucgucgccaugcuguacacgccccugcgguccaacggcagcggcgacgacguguucaccguguccugccgcguccucacccggcccagccccgacuucgacuucaacuaccuggugccgcccaccguggaguccaagacgaagcccuucagcguccccgugcugacccucaacgagcugaccaacucccgcuucccggugcccaucgacgccauguacaccagccccaacgacuccaucgucgugcagccccagaacgggcgggcgacgaucgacggcgagcugcucgggaccacccagcugaucccgagcggcaucugcuccuuccgcggcaagaucaccacgcaccugagcgacgaccggcaccucuggaacauccaggucuccaaccugaacgggacccccuucgaccccaccgacgacgugccggcgccccugggcaugcccgacuucagcgggcagaucuucggcguggucagccagcgcgacaccgggacgaaccccgccaaccgggcccacgacgccgugcucgccaccuacuccgccaaguacaccccgaagcugggcagcgugcagaucggcaccugggacacggaggaccugcucgagcgccagcccgucaaguucacccccguggggcugaacgagaucggccaggacaagcacuucgaccagugggugcugcccaacuacuccggggcccucggccugaacaugcaccuggccccggccgucagcccccucuuccccggggagcggcugcuguucuuccgcuccuacaucccccucaagggcggcuacggggacccguucaucgacugccuggugccccaggaguggauccagcacuucuaccaggagagcgcgcccgcccaguccagcguggcccugcuccgguacgucaaccccgacaccggccgcacccuguucgaggccaagcugcacaaggagggguucaucacgguguccagcaccgagaaccggccggugaucgucccgcccaacggcuacuuccgcuucgacuccugggugaaccaguucuacagccuggcgcccauggggaccggcaacggccgccggcgcaugcaguga

SEQ ID NO: 10310 - RNA, 1623 nt, Artificial Sequence
  derived and/or modified sequence opt1 from capsid_protein__Norovirus__AAS86780
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgauccagggcauguucaugucccccgacgucaaccagagcgugcaguuccagaacgggcgcugccagaucgacggccagcugcaggggaccacccccgugucccucagccagcugugcaagauccggggcaagacguccagcaacgcccgcguccugaaccucagcgagguggacgggacccccuucgucccgcuggagucccccgcccccgugggcuucccggaccugggcgggugcgacuggcacgugaacuucaccuuccaggcgcagaaccaggaccccagccaguccgucaccuucgccacgaacgacgccagcuucgugcccuaccucggcuccaucagcccccacaacgggggcgacuuccacgccggggacaucaucggcucccugggcuggaucagcgccccguccgacaacacccagcugaacguguggaccauccccaaguacgggagcucccuccccgacgucacccaccuggcgcccgccguguucccgcccggcuucggggaggugauccuguacuucuacagcacguuccccggcuccgggcagcccagccagcuccaggucccgugccugcugccccaggaguucaucacccacuucugcaacgagcaggcccccaucgccggcgaggcggcccuccugcacuacguggaccccgacaccggccggaaccugggggaguucaagcucuacccggacggcuucaugaccugcgugcccaacuccgucagcuccgggccccagacgcugcccaucaacggcguguucguguucgucagcugggugucccgcuucuaccagcugaagccggugggcaccgccagcgccgcccggcgccucgggcugcggcgcaucuga

SEQ ID NO: 10311 - RNA, 1623 nt, Artificial Sequence
  derived and/or modified sequence opt1 from capsid_protein__Norovirus__AAS86783
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguuccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacgugccccucaaggaccuguccaacagccgggugcccgucccgauccagggcauguucaugucccccgacgugaaccagagcgugcaguuccagaacgggcgcugccagaucgacggccagcugcaggggaccacccccgucucccucagccagcugugcaagauccggggcaagacguccagcaacgcccgcgugcugaaccucagcgaggucgacgggucccccuucaucccgcuggagagccccgcccccgugggcuucccggaccugggcgggugcgacuggcacgugaacuucaccuuccaggcgcaggaccaggaccccucccagagcgucaccuucgccaccaacgacgccuccuucgugcccuaccucggcagcaucagcccccacaacgggggcgacuuccacuccggggacaucaucggcucccugggcuggaucagcgccccguccgacagcucccagcugaacguguggacgauccccaaguacgggagcucccuccccgacgucacccaccuggcccccgcgguguucccgcccggcuucggggaggugauccuguacuucuacagcaccuuccccggcuccgggcagcccguccagcuccaggugccgugccugcugccccaggaguucaucacccacuucugcaacgagcaggcccccaucgccggcgaggccgcgcuccugcacuacguggaccccgacacgggccggaaccugggggaguucaagcucuacccggacggcuucaugaccugcguccccaacagcguguccagcgggccccagacccugcccaucaacggcguguucgucuucgugagcugggugucccgcuucuaccagcugaagccggucggcaccgccagcguggcccggcgccucgggcugcggcgcaucuga

SEQ ID NO: 10312 - RNA, 1623 nt, Artificial Sequence
  derived and/or modified sequence opt1 from capsid_protein__Norovirus__AAS86786
augaagauggccagcaacgacgccgcgcccuccaacgacggcgccaccgggcuggugccggagaucaacaacgagacccucccccuggagcccgucgccggcgccgccaucgcggcccccgugacggggcagaacaacaucaucgacccguggauccgcaccaacuucgugcaggcccccaacggcgaguucaccgucagcccccggaacucccccggggagauccugcucaaccuggagcugggcccggaccucaaccccuaccuggcccaccugagccgcauguacaacggcuacgccgggggcguggaggugcagguccuccuggccgggaacgccuucaccgccggcaagauccuguucgccgcggugccgcccaacuuccccguggaguuccucucccccgcccagaucacgaugcugccccaccugaucgucgacgugcggacccucgagcccaucaugaucccgcugcccgacgugcgcaacaccuucuuccacuacaacaaccagcccgccaaccggaugcgccuggucgccaugcucuacacgccccugcggagcaacggguccggcgacgacguguucaccgugagcugccgcguccugacccggccgacccccgacuucgaguucaccuaccucgugccgcccuccguggagagcaagacgaagcccuucucccugcccauccugaccaucagcgagcucaccaacucccgcuuccccgcccccaucgacagccuguucaccgcgcagaacaacaaccugaacguccagugccagaacggccggugcacgcucgacggggagcugcagggcaccacccagcugcucccguccgggaucugcgccuuccgcggccggcugaccgccgacguggacggcagccacgacgaccgcuggcacaugcagcugacgaaccucaacgggacccccuucgaccccaccgaggacgugccggcgccccugggcacccccgacuucacggggcuccuguucggcgucgccucccagcggaacguggggagcaaccccaacaccacccgcgcgcacgaggccguggucuccaccacgagcagccaguucgugccgaagcugggcuccgucaacuucggcagcaccuccaccgacuuccagcugcagcagcccaccaaguucacgcccguggggaucaagaucgagagcggccacgaguucgaccagugggcccucccccgguacuccgggcaccugacccugaacaugaaccucgccccgcccaucgcccccaacuuccccggcgagcagcugcuguucuuccgcagcaacgugccgugcgccgggggcgucuccgacggcgugaucgacugccuccugccccaggaguggauccagcacuucuaccaggagagcgcgcccucccagagcgacguggcccugauccgguacgucaaccccgacaccgggcgcacccucuucgaggccaagcugcaccggacgggcuacaucaccguggcgcacuccggggacuacccgcuggugguccccagcaacggcuacuuccgcuucgacuccugggugaaccaguucuacagccuggcccccauggggaccggcaacggccgccggcgcgugcaguga

SEQ ID NO: 10313 - RNA, 1623 nt, Artificial Sequence
  derived and/or modified sequence opt1 from capsid_protein__Norovirus__AAS86792
augaagauggccagcaacgacgccgcgcccuccaacgacggcgccgccgggcuggugcccgaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggagauccuccugaaccuggagcucggccccgagcugaacccguaccuggcccaccucgcccgcauguacaacggcuacgccgggggcguggagguccaggugcugcuggccgggaacgccuucaccgcgggcaagcucguguucgccgccaucccgccccacuuccccgucgacaaccugucccccgggcagaucaccauguucccccacgugaucaucgacgugcggacccuggagcccguccuccugccccugccggacgugcgcaacaacuucuuccacuacaaccagcagagcgaccagcggaugcgccucaucgccaugcuguacacgccccugcgguccaacggcagcggcgacgacguguucaccgucuccugccgcgugcucacccggcccagccccgacuucgacuucaacuaccuggugccgcccaccgucgaguccaagacgaagcccuucagcgugcccgugcugacccucaacgagcugaccaacucccgcuucccgguccccaucgacgccauguacaccagccccaacgacuccaucguggugcagccccagaacgggcgggcgacgaucgacggcgagcugcucgggaccacccagcugaucccgagcggcaucugcuccuuccgcggcaagaucaccacgcaccugagcgacgaccggcaccucuggaacguccagguguccaaccugaacgggacccccuucgaccccaccgacgacgucccggcgccccugggcaugcccgacuucagcgggcagaucuucggcguggugagccagcgcgacaccgggacgaaccccgccaaccgggcccacgacgccguccucgccaccuacuccgccaaguacaccccgaagcugggcagcgugcagaucggcaccugggacacggaggaccugcucgagcgccagcccgugaaguucacccccgucgggcugaacgagaucggccaggacaagcacuucgaccagugggugcugcccaacuacuccggggcccucggccugaacaugcaccuggccccggccgugagcccccucuuccccggggagcggcugcuguucuuccgcuccuacaucccccucaagggcggccacggggacccguucaucgacugccuggucccccaggaguggauccagcacuucuaccaggagagcgcgcccgcccaguccagcguggcccugcuccgguacgugaaccccgacaccggccgcacccuguucgaggccaagcugcacaaggagggguucaucacggucuccagcaccgagaaccggccggugaucgugccgcccaacggcuacuuccgcuucgacuccugggucaaccaguucuacagccuggcgcccauggggaccggcaacggccgccggcgcaugcaguga

SEQ ID NO: 10314 - RNA, 1623 nt, Artificial Sequence
  derived and/or modified sequence opt1 from capsid_protein__Norovirus__AAS86795
augaagauggccagcaacgacgccgcgcccuccaacgacggcgccgccgggcuggugcccgaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggagauccuccugaaccuggagcucggccccgagcugaacccguaccuggcccaccucgcccgcauguacaacggcuacgccgggggcguggagguccaggugcugcuggccgggaacgccuucaccgcgggcaagcucguguucgccgccaucccgccccacuuccccgucgacaaccugucccccgggcagaucaccauguucccccacgugaucaucgacgugcggacccuggagcccguccuccugccccugccggacgugcgcaacaacuucuuccacuacaaccagcagagcgaccagcggaugcgccucguggccaugcuguacacgccccugcgguccaacggcagcggcgacgacgucuucaccguguccugccgcgugcucacccggcccagccccgacuucgacuucaacuaccuggucccgcccaccguggaguccaagacgaagcccuucagcgugcccguccugacccucaacgagcugaccaacucccgcuucccggugcccaucgacgccauguacaccagccccaacgacuccaucgugguccagccccagaacgggcgggcgacgaucgacggcgagcugcucgggaccacccagcugaucccgagcggcaucugcuccuuccgcggcaagaucaccacgcaccugagcgacgaccggcaccucuggaacauccagguguccaaccugaacgggacccccuucgaccccaccgacgacgucccggcgccccugggcaugcccgacuucagcgggcagaucuucggcguggugagccagcgcgacaccgggacgaaccccgccaaccgggcccacgacgccguccucgccaccuacuccgccaaguacaccccgaagcugggcagcgugcagaucggcaccugggacacggaggaccugcucgagcgccagcccgugaaguucacccccgucgggcugaacgagaucggccaggacaagcacuucgaccagugggugcugcccaacuacuccggggcccucggccugaacaugcaccuggccccggccgugagcccccucuuccccggggagcggcugcuguucuuccgcuccuacaucccccucaagggcggccacggggacccguucaucgacugccuggucccccaggaguggauccagcacuucuaccaggagagcgcgcccgcccaguccagcguggcccugcuccgguacgugaaccccgacaccggccgcacccuguucgaggccaagcugcacaaggagggguucaucacggucuccagcaccgagaaccggccggugaucgugccgcccaacggcuacuuccgcuucgacuccugggucaaccaguucuacagccuggcgcccauggggaccggcaacggccgccggcgcaugcaguga

SEQ ID NO: 10315 - RNA, 1623 nt, Artificial Sequence
  derived and/or modified sequence opt1 from capsid_protein__Norovirus__AAS86798
augaagauggccagcaacgacgccgcgcccuccaacgacggcgccgccgggcuggugcccgaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggagauccuccugaaccuggagcucggccccgagcugaacccguaccuggcccaccucgcccgcauguacaacggcuacgccgggggcguggagguccaggugcugcuggccgggaacgccuucaccgcgggcaagcucguguucgccgccaucccgccccacuuccccgucgacaaccugucccccgggcagaucaccauguucccccacgugaucaucgacgugcggacccuggagcccguccuccugccccugccggacgugcgcaacaacuucuuccacuacagccagcaguccgaccagcggaugcgccucguggccaugcuguacacgccccugcggagcaacggcuccggcgacgacgucuucaccgugagcugccgcgugcucacccggcccucccccgacuucgacuucaacuaccuggucccgcccaccguggagagcaagacgaagcccuucuccgugcccguccugacccucaacgagcugaccaacagccgcuucccggugcccaucgacgccauguacaccucccccaacgacagcaucgugguccagccccagaacgggcgggcgacgaucgacggcgagcugcucgggaccacccagcugaucccguccggcaucugcagcuuccgcggcaagaucaccacgcaccuguccgacgaccggcaccucuggaacauccaggugagcaaccugaacgggacccccuucgaccccaccgacgacgucccggcgccccugggcaugcccgacuucagcgggcagaucuucggcguggugucccagcgcgacaccgggacgaaccccgccaaccgggcccacgacgccguccucgccaccuacagcgccaaguacaccccgaagcugggcuccgugcagaucggcaccugggacacggaggaccugcucgagcgccagcccgugaaguucacccccgucgggcugaacgagaucggccaggacaagcacuucgaccagugggugcugcccaacuacagcggggcccucggccugaacaugcaccuggccccggccgugagcccccucuuccccggggagcggcugcuguucuuccgcuccuacaucccccucaagggcggccacggggacccguucaucgacugccuggucccccaggaguggauccagcacuucuaccaggaguccgcgcccgcccagagcuccguggcccugcuccgguacgugaaccccgacaccggccgcacccuguucgaggccaagcugcacaaggagggguucaucacggucagcuccaccgagaaccggccggugaucgugccgcccaacggcuacuuccgcuucgacagcugggucaaccaguucuacucccuggcgcccauggggaccggcaacggccgccggcgcaugcaguga

SEQ ID NO: 10316 - RNA, 1623 nt, Artificial Sequence; identical to SEQ ID NO: 10314
  derived and/or modified sequence opt1 from capsid_protein__Norovirus__AAS86801

SEQ ID NO: 10317 - RNA, 1623 nt, Artificial Sequence
  derived and/or modified sequence opt1 from capsid_protein__Norovirus__AAS86804
augaagauggccagcaacgacgccgcgcccuccaacgacggcgccgccgggcuggugcccgaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggaggugcuccugaaccuggagcucggccccgagcugaacccguaccuggcccaccucucccgcauguacaacggcuacgccgggggcgucgagguccaggugcugcuggccgggaacgccuucaccgccggcaagcucguguucgcggccaucccgccccacuuccccguggacaaccugagccccgggcagaucaccauguucccccacgugaucaucgacguccggacccuggagcccgugcuccugccccugccggacgugcgcaacaacuucuuccacuacaaccagcaguccgaccagcggaugcgccucaucgccaugcuguacacgccccugcggagcaacggcuccggcgacgacgucuucaccgugagcugccgcgugcucacccggcccucccccgacuucgacuucaacuaccuggucccgcccaccguggagagcaagacgaagcccuucuccgugcccguccugacccucaacgagcugaccaacagccgcuucccggugcccaucgacgccauguacaccucccccaacgacagcguggucgugcagccccagaacgggcgggccacgaucgacggcgagcugcucgggaccacccagcugaucccguccggcaucugcagcuuccgcggcaagaucaccacgcaccuguccgacgaccggcaccucuggaacauccaggucagcaaccugaacgggacccccuucgaccccaccgacgacgugccggcgccccugggcaugcccgacuucagcgggcagaucuucggcgugaucucccagcgcgacaccgggacgaaccccgccaaccgggcccacgacgccguccucgccaccuacagcgcgaaguacaccccgaagcugggcuccgugcagaucggcaccugggacacggaggaccugcucgagcgccagcccgugaaguucacccccgucgggcugaacgagaucggccaggacaagcacuucgaccagugggugcugcccaacuacagcggggcccucggccugaacaugcaccuggccccggccgugagcccccucuuccccggggagcggcugcuguucuuccgcuccuacaucccccucaagggcggccacgggaacccguucaucgacugccuggucccccaggaguggauccagcacuucuaccaggaguccgcccccgcgcagagcuccguggcccugcuccgguacgugaaccccgacaccggccgcacccuguucgaggccaagcugcacaaggagggguucaucacggucagcuccaccgagaaccggccggugaucgugccgcccaacggcuacuuccgcuucgacagcugggucaaccaguucuacucccuggcccccauggggaccggcaacggccgccggcgcaugcaguga

SEQ ID NO: 10318 - RNA, 1593 nt, Artificial Sequence
  derived and/or modified sequence opt1 from capsid_protein__Norovirus__AAS86807
augaugauggccagcaaggacgccaccuccaacguggacggcgcgagcggggccggccagcugguccccgaggccaacaccuccgacccgcucgccauggaccccguggccgggagcuccacggcgguggccaccgccggccaggucaaccccaucgaccccuggaucaucaacaacuucgugcaggccccgcagggggaguucaccaucagccccaacaacacccccggcgacgugcuguucgaccugucccucggcccccaccugaacccguuccugcuccaccugagccagauguacaacgggugggucggcaacaugcgcgugcggaucaugcuggcggggaacgccuucacggccggcaagaucaucguguccugcaucccgcccggguucggcagccacaaccucaccaucgcccaguccacccuguucccccacgucaucgccgacgugcgcacccuggaccccaucgaggugccccucgaggacguccggaacgugcuguuccacaacaacgaccgcaaccagcagacgaugcggcuggugugcaugcucuacacgccccugcgcaccggcgggggcaccggggacagcuucgucguggcgggccgggugaugaccugccccuccccggacuucaacuuccuguuccucgucccgcccaccguggagcagaagacccgccccuucacccugcccaaccugccccucagcucccugagcaacucccgggcgccccugcccaucagcuccaugggcaucagcccggacaacgugcagagcguccaguuccagaacgggcgcugcacgcucgacggccggcugguggggaccacccccgugucccugagccaggucgccaagauccgcggcaccuccaacgggacggugaucaaccucaccgagcuggacggcacccccuuccaccccuucgagggcccggcccccaucggguuccccgaccugggcgggugcgacuggcacgucaacaugacccaguucggccacagcucccagacgcaguucgacguggacaccaccccggagaccuucgugccccaccucgggagcauccaggccaacggcgucggcuccgggaacuacaucggcgugcugagcuggaucuccccgcccagccaccccuccgggagccagguggaccuguggaagauccccaacuacggcuccagcaucacggaggccacccaccucgcccccuccgucuucccgcccggguucggcgaggugcugguguucuucaugagcaagauccccggccccggggccuacaaccugcccugccuccugccgcaggaguacaucucccacuucgccagcgagcaggcccccaccgucggcgaggcggcccugcuccacuacguggaccccgacaccgggcggaaccugggcgaguucaaggccuaccccgacggcuuccugacgugcgugccgaacggggccuccagcggcccccagcagcuccccaucaacggggucuucguguucgugagcugggucucccgcuucuaccagcugaagcccgugggcaccgccagcuccgcgcgggggcgccugggccuccggcgcuga

SEQ ID NO: 10319 - RNA, 1623 nt, Artificial Sequence
  derived and/or modified sequence opt1 from capsid_protein__Norovirus__AAT00237
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcgccuuccggggcgacgugacccacaucgccgggacccacaacuacaccaugaaccuggccucccagaacuggaacaacuacgacccgacggaggagauccccgcgccccugggcacccccgacuucguggggcgcauccagggcaugcucacccagaccacgcgcggggacggcagcacccggggccacaaggccaccgucuccaccggggacgugcacuucacgccgaagcugggcagcauccaguucaacaccgacaccaacaacgacuucgagaccgggcagaacacgaaguucacccccgugggcgucgugcaggacgggaacggcacccaccagaacgagccccagcagugggugcugcccuccuacagcggccggaccgggcacaacguccaccucgccccggccguggcccccacguuccccggcgagcagcugcuguucuuccgcagcaccaugcccgggugcuccggcuacccgaacaugaaccucgacugccugcugccccaggagugggugcagcacuucuaccaggaggcggcccccgcccagagcgacgucgcccuccugcgguucgugaaccccgacaccgggcgcgugcuguucgagugcaagcuccacaaguccggcuacgucaccguggcgcacaccggccagcacgaccuggugaucccgcccaacggguacuuccgguucgacagcugggucaaccaguucuacacgcuggcccccaugggcaacgggaccggccgccggcgcgcccucuga

SEQ ID NO: 10320 - RNA, 1623 nt, Artificial Sequence; identical to SEQ ID NO: 10319
  derived and/or modified sequence opt1 from capsid_protein__Norovirus__AAT00240

SEQ ID NO: 10321 - RNA, 1623 nt, Artificial Sequence; identical to SEQ ID NO: 10319
  derived and/or modified sequence opt1 from capsid_protein__Norovirus__AAT00243

SEQ ID NO: 10322 - RNA, 1623 nt, Artificial Sequence; identical to SEQ ID NO: 10319
  derived and/or modified sequence opt1 from capsid_protein__Norovirus__AAT00246

SEQ ID NO: 10323 - RNA, 1623 nt, Artificial Sequence
  derived and/or modified sequence opt1 from capsid_protein__Norovirus__AAT00249
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcgccuuccggggcgacgugacccacaucgccgggacccacaacuacaccaugaaccuggccucccagaacuggaacaacuacgacccgacggaggagauccccgcgccccugggcacccccgacuucguggggcgcauccagggcaugcucacccagaccacgcgcggggacggcagcacccggggccacaaggccaccgucuccaccggggacgugcacuucacgccgaagcugggcagcauccaguucaacaccgacaccaacaacgacuucgagaccgggcagaacacgaaguucacccccgugggcgucgugcaggacgggaacggcacccaccagaacgagccccagcagugggugcugcccuccuacagcggccggaccgggcacaacguccaccucgccccggccguggcccccacguuccccggcgagcagcugcuguucuuccgcagcaccaugcccgggugcuccggcuacccgaacaugaaccucgacugccugcugccccaggagugggugcagcacuucuaccaggaggcggcccccgcccagagcgacgucgcccuccugcgguucgugaaccccgacaccgggcgcgugcuguucgagugcaagcuccacaagaccggcuacgucaccguggcgcacacgggccagcacgaccuggugaucccgcccaacggguacuuccgguucgacuccugggucaaccaguucuacacccuggcccccaugggcaacgggaccggccgccggcgcgcccucuga

SEQ ID NO: 10324 - RNA, 1623 nt, Artificial Sequence
  derived and/or modified sequence opt1 from capsid_protein__Norovirus__AAT00255
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcauccaguucaacaccgacaccaacaacgacuucgagacggggcagaacacccgguucacccccgugggcgucgugcaggacgggaacggcacccaccagaacgagccccagcagugggugcugcccuccuacagcggccgcacggggcacaacguccaccucgccccggccguggcccccaccuuccccggcgagcagcugcuguucuuccggagcaccaugcccgggugcuccggcuacccgaacaugaaccucgacugccugcugccccaggagugggugcagcacuucuaccaggaggccgcgcccgcccagagcgacgucgcccuccugcgcuucgugaaccccgacaccgggcgggugcuguucgagugcaagcuccacaaguccggcuacgucaccguggcccacacgggccagcacgaccuggugaucccgcccaacggguacuuccgcuucgacagcugggucaaccaguucuacacccuggcgcccaugggcaacgggaccggccggcgccgcgcccucuga

SEQ ID NO: 10325 - RNA, 1623 nt, Artificial Sequence; identical to SEQ ID NO: 10324
  derived and/or modified sequence opt1 from capsid_protein__Norovirus__AAT00258

SEQ ID NO: 10326 - RNA, 1623 nt, Artificial Sequence; identical to SEQ ID NO: 10324
  derived and/or modified sequence opt1 from capsid_protein__Norovirus__AAT00261

SEQ ID NO: 10327 - RNA, 1623 nt, Artificial Sequence; identical to SEQ ID NO: 10324
  derived and/or modified sequence opt1 from capsid_protein__Norovirus__AAT00264

SEQ ID NO: 10328 - RNA, 1623 nt, Artificial Sequence; identical to SEQ ID NO: 10324
  derived and/or modified sequence opt1 from capsid_protein__Norovirus__AAT00267

SEQ ID NO: 10329 - RNA, 1623 nt, Artificial Sequence; identical to SEQ ID NO: 10324
  derived and/or modified sequence opt1 from capsid_protein__Norovirus__AAT00270

SEQ ID NO: 10330 - RNA, 1623 nt, Artificial Sequence; identical to SEQ ID NO: 10324
  derived and/or modified sequence opt1 from capsid_protein__Norovirus__AAT00273

SEQ ID NO: 10331 - RNA, 1623 nt, Artificial Sequence; identical to SEQ ID NO: 10324
  derived and/or modified sequence opt1 from capsid_protein__Norovirus__AAT00276

SEQ ID NO: 10332 - RNA, 1623 nt, Artificial Sequence; identical to SEQ ID NO: 10324
  derived and/or modified sequence opt1 from capsid_protein__Norovirus__AAT00279

SEQ ID NO: 10333 - RNA, 1623 nt, Artificial Sequence; identical to SEQ ID NO: 10324
  derived and/or modified sequence opt1 from capsid_protein__Norovirus__AAT00282

SEQ ID NO: 10334 - RNA, 1623 nt, Artificial Sequence; identical to SEQ ID NO: 10324
  derived and/or modified sequence opt1 from capsid_protein__Norovirus__AAT00285

SEQ ID NO: 10335 - RNA, 1623 nt, Artificial Sequence; identical to SEQ ID NO: 10324
  derived and/or modified sequence opt1 from capsid_protein__Norovirus__AAT00288

SEQ ID NO: 10336 - RNA, 1623 nt, Artificial Sequence; identical to SEQ ID NO: 10324
  derived and/or modified sequence opt1 from capsid_protein__Norovirus__AAT00291

SEQ ID NO: 10337 - RNA, 1623 nt, Artificial Sequence; identical to SEQ ID NO: 10324
  derived and/or modified sequence opt1 from capsid_protein__Norovirus__AAT00294

SEQ ID NO: 10338 - RNA, 1623 nt, Artificial Sequence; identical to SEQ ID NO: 10324
  derived and/or modified sequence opt1 from capsid_protein__Norovirus__AAT00297

SEQ ID NO: 10339 - RNA, 1623 nt, Artificial Sequence; identical to SEQ ID NO: 10324
  derived and/or modified sequence opt1 from capsid_protein__Norovirus__AAT00300

SEQ ID NO: 10340 - RNA, 1623 nt, Artificial Sequence; identical to SEQ ID NO: 10324
  derived and/or modified sequence opt1 from capsid_protein__Norovirus__AAT00303

SEQ ID NO: 10341 - RNA, 1623 nt, Artificial Sequence; identical to SEQ ID NO: 10324
  derived and/or modified sequence opt1 from capsid_protein__Norovirus__AAT00306

SEQ ID NO: 10342 - RNA, 1623 nt, Artificial Sequence; identical to SEQ ID NO: 10324
  derived and/or modified sequence opt1 from capsid_protein__Norovirus__AAT00309

SEQ ID NO: 10343 - RNA, 1623 nt, Artificial Sequence; identical to SEQ ID NO: 10324
  derived and/or modified sequence opt1 from capsid_protein__Norovirus__AAT00312

SEQ ID NO: 10344 - RNA, 1623 nt, Artificial Sequence; identical to SEQ ID NO: 10324
  derived and/or modified sequence opt1 from capsid_protein__Norovirus__AAT00315

SEQ ID NO: 10345 - RNA, 1623 nt, Artificial Sequence; identical to SEQ ID NO: 10324
  derived and/or modified sequence opt1 from capsid_protein__Norovirus__AAT00318

SEQ ID NO: 10346 - RNA, 1623 nt, Artificial Sequence; identical to SEQ ID NO: 10324
  derived and/or modified sequence opt1 from capsid_protein__Norovirus__AAT00321

SEQ ID NO: 10347 - RNA, 1623 nt, Artificial Sequence; identical to SEQ ID NO: 10319
  derived and/or modified sequence opt1 from capsid_protein__Norovirus__AAT00324

SEQ ID NO: 10348 - RNA, 1623 nt, Artificial Sequence
  derived and/or modified sequence opt1 from capsid_protein__Norovirus__AAT00330
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcauccaguucaacaccgacaccaacaacgacuucgagacggggcagaacaccaaguucacccccgugggcgucgugcaggacgggaacggcacccaccagaacgagccccagcagugggugcugcccuccuacagcggccggacggggcacaacguccaccucgccccggccguggcccccaccuuccccggcgagcagcugcuguucuuccgcagcgccaugcccgggugcuccggcuacccgaacaugaaccucgacugccugcugccccaggagugggugcagcacuucuaccaggaggcggcccccgcccagagcgacgucgcccuccugcgguucgugaaccccgacaccgggcgcgugcuguucgagugcaagcuccacaaguccggcuacgucaccguggcgcacaccggccagcacgaccuggugaucccgcccaacggguacuuccgguucgacagcugggucaaccaguucuacacgcuggcccccaugggcaacgggaccggccgccggcgcgcccucuga

SEQ ID NO: 10349 - RNA, 1623 nt, Artificial Sequence; identical to SEQ ID NO: 10348
  derived and/or modified sequence opt1 from capsid_protein__Norovirus__AAT00333

SEQ ID NO: 10350 - RNA, 1623 nt, Artificial Sequence; identical to SEQ ID NO: 10348
  derived and/or modified sequence opt1 from capsid_protein__Norovirus__AAT00336

SEQ ID NO: 10351 - RNA, 1623 nt, Artificial Sequence
  derived and/or modified sequence opt1 from capsid_protein__Norovirus__AAT00342
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcgugcaguucaacaccgacaccaacaacgacuucgagacggggcagaacaccaaguucacccccgucggcguggugcaggacgggaacggcgcccaccagaacgagccccagcaguggguccugcccuccuacagcggccggaccgggcacaacgugcaccucgccccggccguggcccccacguuccccggcgagcagcugcuguucuuccgcagcaccaugcccgggugcuccggcuacccgaacaugaaccucgacugccugcugccccaggaguggguccagcacuucuaccaggaggcggcccccgcccagagcgacguggcccuccugcgguucgugaaccccgacaccgggcgcguccuguucgagugcaagcuccacaaguccggcuacgugaccguggcgcacaccggccagcacgaccuggucaucccgcccaacggguacuuccgguucgacagcugggugaaccaguucuacacgcuggcccccaugggcaacgggaccggccgccggcgcgcccucuga

SEQ ID NO: 10352 - RNA, 1623 nt, Artificial Sequence; identical to SEQ ID NO: 10324
  derived and/or modified sequence opt1 from capsid_protein__Norovirus__AAT00345

SEQ ID NO: 10353 - RNA, 1623 nt, Artificial Sequence
  derived and/or modified sequence opt1 from capsid_protein__Norovirus__AAT00348
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgaggacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcauccaguucaacaccgacaccaacaacgacuucgagacggggcagaacacccgguucacccccgugggcgucgugcaggacgggaacggcacccaccagaacgagccccagcagugggugcugcccuccuacagcggccgcacggggcacaacguccaccucgccccggccguggcccccaccuuccccggcgagcagcugcuguucuuccggagcaccacccccgggugcuccggcuacccgaacaugaaccucgacugccugcugccccaggagugggugcagcacuucuaccaggaggccgcgcccgcccagagcgacgucgcccuccugcgcuucgugaaccccgacaccgggcgggugcuguucgagugcaagcuccacaaguccggcuacgucacgguggcccacaccggccagcacgaccuggugaucccgcccaacggguacuuccgcuucgacagcugggucaaccaguucuacacccuggcgcccaugggcaacgggaccggccggcgccgcgcccucuga

SEQ ID NO: 10354 - RNA, 1623 nt, Artificial Sequence; identical to SEQ ID NO: 10324
  derived and/or modified sequence opt1 from capsid_protein__Norovirus__AAT00351

SEQ ID NO: 10355 - RNA, 1623 nt, Artificial Sequence; identical to SEQ ID NO: 10324
  derived and/or modified sequence opt1 from capsid_protein__Norovirus__AAT00354

SEQ ID NO: 10356 - RNA, 1623 nt, Artificial Sequence; identical to SEQ ID NO: 10324
  derived and/or modified sequence opt1 from capsid_protein__Norovirus__AAT00357

SEQ ID NO: 10357 - RNA, 1623 nt, Artificial Sequence; identical to SEQ ID NO: 10324
  derived and/or modified sequence opt1 from capsid_protein__Norovirus__AAT00360

SEQ ID NO: 10358 - RNA, 1623 nt, Artificial Sequence; identical to SEQ ID NO: 10319
  derived and/or modified sequence opt1 from capsid_protein__Norovirus__AAT00363

SEQ ID NO: 10359 - RNA, 1623 nt, Artificial Sequence; identical to SEQ ID NO: 10324
  derived and/or modified sequence opt1 from capsid_protein__Norovirus__AAT00366

SEQ ID NO: 10360 - RNA, 1623 nt, Artificial Sequence; identical to SEQ ID NO: 10324
  derived and/or modified sequence opt1 from capsid_protein__Norovirus__AAT00369

SEQ ID NO: 10361 - RNA, 1623 nt, Artificial Sequence; identical to SEQ ID NO: 10324
  derived and/or modified sequence opt1 from capsid_protein__Norovirus__AAT00372

SEQ ID NO: 10362 - RNA, 1623 nt, Artificial Sequence; identical to SEQ ID NO: 10324
  derived and/or modified sequence opt1 from capsid_protein__Norovirus__AAT00375

SEQ ID NO: 10363 - RNA, 1647 nt, Artificial Sequence
  derived and/or modified sequence opt1 from capsid_protein__Norovirus__AAT70110
augaagauggccagcaaggacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucacggugagcugccgggugcugacccgccccucccccgacuucagcuucaacuuccuggugcccccgaccguggaguccaagaccaagcccuucacgcuccccauccugaccaucagcgagauguccaacagccgguuccccgugccgaucgacucccugcacaccagccccaccgagaacaucgucgugcagugccagaacgggcgcgugacgcucgacggcgagcugauggggaccacccagcugcuccccucccagaucugcgccuuccggggcguccugacccgcagcacgucccgggccagcgaccaggcggacaccgccacgccccgccuguucaacuacuacuggcacauccagcucgacaaccugaacggcaccccguacgaccccgccgaggacauccccgggccgcugggcacccccgacuuccgggggaagguguucggcguggccagccagcgcaaccccgacuccaccacccgggcccacgaggcgaaggucgacaccacggccgggcgcuucacccccaagcucggcagccuggagaucuccaccgagagcggcgacuucgaccagaaccagccgacccgguucacgcccguggggaucggcgucgacaacgaggccgacuuccagcaguggucccugcccgacuacagcgggcaguucacccacaacaugaaccucgcccccgcgguggccccgaacuuccccggcgagcagcugcuguucuuccgcucccagcuccccagcuccgggggccggagcaacggcauccuggacugccuggugccccaggaguggguccagcacuucuaccaggaguccgccccgagccagacccagguggcccucgugcgcuacgucaaccccgacaccgggcgcgugcuguucgaggccaagcugcacaagcucggcuucaugacgaucgcgaagaacggggacucccccaucaccgugcccccgaacggcuacuuccgguucgagagcugggucaaccccuucuacacccuggcccccauggggaccggcaacggccgccggcgcauccaguga

SEQ ID NO: 10364 - RNA, 1623 nt, Artificial Sequence
  derived and/or modified sequence opt1 from capsid_protein__Norovirus__AAT73592
auggccagcaaggacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcaccaacuucguccaggcgccgaacggcgaguucaccguguccccgcggaacgcccccggggaggugcugcucaaccuggagcugggccccgagcucaaccccuaccuggcccaccuggcccgcauguacaacggcuacgccgggggcauggagguccaggugaugcucgcggggaacgccuucaccgccggcaagcugguguucgccgccgucccgccccacuuccccguggagaaccugagcccccagcagaucacgauguucccccacgugaucaucgacguccggacccucgagcccgugcugcugccccucccggacgugcgcaacaacuucuuccacuacaaccagaaggacgaccccaagaugcggaucgucgcgaugcuguacacgccccugcgcuccaacgggagcggcgacgacguguucaccguguccugccggguccucacccgccccagcccggacuucgacuucaccuaccuggugccgcccaccguggaguccaagaccaagcccuucacgcugcccauccucacccugggcgagaccagcaacucccgguuccccguccccaucgaccagauguacaccagccccaacgaggugaucuccgugcagugccagaacgggcgcugcacgcuggacggcgagcuccaggggaccacccagcugcaggucagcggcaucugcgccuucaagggccaggugaccgcccaccuccaggacaacgagcaccucuacaacgucacgaucaccaaccugaacggguccccguucgaccccagcgaggacauccccgccccgcugggcgugcccgacuucgaggggcggguguucggcgucaucucccagcgcgacaacuacaacagcgggggccagaaccagcccgccaaccggucccacgacgcgguggugcccaccuacaccgcccaguacacgccgaagcucggccagauccagaucgggaccuggcagaccgacgacaucaccgucgaccagcccgccaaguucacgcccgugggccugagcgacaccgaccacuucaaccaguggguggucccccgcuacgccggggcccugaaccucaacaccaaccuggcgccgagcguggcccccguguuccccggcgagcggcugcuguucuuccgcuccuacaucccccugaagggcggguucggcaacccggccaucgacugccuggucccccaggaguggauccagcacuucuaccaggaggccacccccagccucuccgagguggcgcuggugcgguacaucaaccccgacacggggcgcgcccuguucgaggccaagcuccaccgggccggcuucaugaccgucagcuccaacaccagcgccccgguggugguccccgcgaacggguacuuccgcuucgacuccugggugaaccaguucuacagccuggcccccaugggcaccgggaacggccggcgccgcauccaguga

SEQ ID NO: 10365 - RNA, 1614 nt, Artificial Sequence
  derived and/or modified sequence opt1 from capsid_protein__Norovirus__AAT78480
auggccagcaaggacgccgcgcccuccaacgacggcgccaccgggcuggugccggagaucaacaccgagacgcucccccuggagcccgucgccggcgccgccaucgcggcccccgugaccgggcagaacaacaucaucgacccguggauccgcaacaacuucgugcaggcccccaacggcgaguucaccgucagcccccggaacucccccggggagauccugaugaaccucgagcugggcccggaccugaaccccuaccucgcccaccugagccgcauguacaacggcuacgccgggggcguggaggugcagguccugcucgccgggaacgccuucaccgccggcaagauccuguucgccgcggugccgcccaacuuccccguggacaugcugucccccgcccagaucacgaugcucccccaccugaucgucgacgugcggacccuggagcccaucaugaucccgcuccccgacgugcgcaacgucuucuaccacuucaacaaccagcccgcgccccggaugcgccugguggccaugcuguacaccccgcuccggagcaacggguccggcgacgacguguucaccgucagcugccgcgugcugacgcggcccacccccgacuucgaguucaccuaccuggugcccccguccgucgagagcaagaccaagcccuucacgcuccccauccugaccaucggcgagcugaccaacucccgcuuccccgccccgaucgaccagcucuacaccagccccaacgcggacguggugguccagccccagaacgggcggugcucccuggacggcgagcugcaggggacgacccagcuccugaccaccgccaucugcagcuaccgcggcaugacguccaacccgacccgggacuacugggacggccaccuccugcaccuggugcaccccaacggggccaccuacgaccccaccgaggacgugcccgccccguucggcacgcaggacuuccgcgggauccuguacggcguccucacccagaacccccgggccagcggggacgaggcggccaacucccagggcguguacaucagcuccaccagcgagaaguucacccccaagcugggcacgaucgggcugcaccagguccagggccaccacagccagcaccagcaguccaaguucacgccccucgggguggccgugaacggcaacaccccguuccgccagugggagcugcccaacuacagcggggcccugacccucaacaccaaccuggcccccgcggucggccccaacuucccgggcgagcagauccuguucuuccgguccaacgugcccagcgugcagggcgggcagcccaucgagaucgacugccucaucccccaggagugggucucccacuucuaccaggagagcgccccgucccagagcgacguggcccuggugcgcuacgucaaccccgacaccgggcggaccaucuucgaggccaagcugcaccgccagggcuucaucaccaucgcggccacgggguccaaccccgugguggugcccccgaacggcuacuuccgguucgacagcugggucaaccaguucuacgcccucgcccccaugggcaccgggaacggccgccgccggauccaguga

SEQ ID NO: 10366 - RNA, 1635 nt, Artificial Sequence
  derived and/or modified sequence opt1 from capsid_protein__Norovirus__AAT78481
auggccagcaaggacgcccccuccaacauggacggcaccagcggggcgggccagcuggugccggaggccaacaccgccgaccccaucccccucgagcccgucgugggggccgccacggcggccgccaccgccggccaggugaacaugaucgacccguggaucaugaacaacuucguccagucccccgagggggaguucaccaucagccccaacaacacccccggcgacauccuguucgaccugcagcucggcccgcaccugaaccccuuccugcagcaccucucccagauguacaacgggugggugggcaacaugcgcgugcggauccugcuggcggggaacgccuucagcgccggcaagaucaucaucugcugcgucccgcccggguucacggcccagaacaucuccaucgcccaggcgaccauguucccccacgugaucgccgacgugcgcguccucgagcccaucgagaucccccuggacgacgugcggaacgugcuguuccacaccaacgagaaccgccccaccaugcggcuccugugcaugcuguacacgccgcuccgcgccggcggcgccagcgccgggaccgaccccuucgucaucgcgggccgggugcugaccugccccucccccgacuucaacuuccuguuccucgugccgcccagcgucgagcagaagacccgccagcugacggugcccaacaucccccugaacaaccucuccaacagcuccgugccggccaugaucaacaagauggccaucagcuccgacgccaaccaggucgugcaguuccagaacgggcggugcaccaccgacggccagcugcugggcaccacgcccaucagcgccucccagguggcgcgcauccgggggaaggucuucagcaccuccagcggcaaggggcucaaccugagcgagcuggacggcucccccuaccacgccuucgagagccccgccccggugggguuccccgaccucggccacugcgacuggcacguguccagcuucaaggccgaccagaacuccagcggcgaccccaucucccgccuggacaucaagcagggggccagcuucgcgccgcaccugggcuccaucgaguacaccaccagccagaaccccgacgggggccagcucgggacgcugaccuggaucuccagccccuccgacgacacccccggccacggcaccaucaaccuguggaagaucccgagcuacggguccacggucaccgagagcgugcaccucgccccgcccaucuacccgcccggcuucggggagacccuggucaaccugauguccaacuuccccaucggccacaccaacagcaacauggcccaggugcccugcacgcucccccaggaguucguggcccacuucgucaacgagcaggcgcccgugcgcggggacgccgcccugcugcacuacguggaccccgacacccaccggaaccucggcgaguucaagcuguaccccgagggcuacaucacgugcguccccaacaccgggggcgggggcccgcagucccugcccaccaacggcguguucaucuucagcagcugggugucccgguacuaccagcucgagcccgucgggaccgccggccccgcccgccggcugggggugcgccggguguga

SEQ ID NO: 10367 - RNA, 1620 nt, Artificial Sequence
  derived and/or modified sequence opt1 from capsid_protein__Norovirus__AAU95776
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaaggugaucuucgccgccgugccgcccaacuucccgaccgaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugaaggccaacaacgcgggcgacgacguguucaccgucagcugccgggugcugacccgccccuccccggacuucgacuucaucuuccucgugccgcccaccgucgagagccggacgaagcccuucaccgugcccauccugaccguggaggagauguccaacagccgcuuccccaucccccuggagaagcucuacaccggccccuccagcgccuucgucgugcagccgcagaacgggcggugcacgaccgacggcguccugcuggggaccacccagcucuccgccgugaacaucugcacguuccgcggcgacgugacccacaucgccggcagccacgacuacaccaugaaccuggccucccagaacuggaacaacuacgaccccaccgaggagauccccgcgccgcuggggacgcccgacuucgucggcaagauccaggggaugcucacccagaccacccgggaggacggcagcacgcgcgcccacaaggccaccgugagcaccggguccgugcacuucacccccaagcugggcagcguccaguacacgaccgacaccaacaacgacuuccagaccggccagaacacgaaguucacccccgugggggugauccaggacggcaacaaccaccagaacgagccgcagcaguggguccugcccaacuacuccgggcggaccggccacaacgugcaccucgcccccgccguggcgcccaccuucccgggggagcagcugcuguucuuccgcagcacgaugcccggcugcuccggcuaccccaacaugaaccucgacugccugcugccccaggaguggguccagcacuucuaccaggaggccgccccggcccagagcgacguggcgcuccugcgguucgugaaccccgacaccgggcgcguccuguucgagugcaagcuccacaaguccggcuacgugaccguggcccacaccgggccccacgaccuggucaucccgcccaacggcuacuuccgguucgacagcugggugaaccaguucuacacccuggcccccauggggaacggcgccggccgccggcgcgcccucuga

SEQ ID NO: 10368 - RNA, 1644 nt, Artificial Sequence
  derived and/or modified sequence opt1 from capsid_protein__Norovirus__AAX32874
augaagauggccagcaacgacgccgcgcccuccaccgacggcagcgccgggcuggugccggaggucaacaacgagaccauggcccucgagcccguggugggcgcgccccuggccgcccccgucgccgggcagcacaacaucaucgacccguggaucaagaugaacuucgugcaggcccccaacggcgaguucacggugagcccccgcaacgcccccggggagauccugcucgaccuggagcugggcccggaccucaaccccuaccugucccaccuggcgcggauguacaacggcuacgccgggggcauggagguccagguggugcucgccgggaacgccuucaccgccggcaagaucaucuucgcggccgucccgcccaacuuccccgccgagaaccuguccgccgcccaggugaccaugugcccccacgugaucgucgacgugcgccagcuggagcccgugaugcuccccaugccggacauccggaacaagcuguuccacuacaaccaggucgacgaccccaagcugcgccuccuggcguaccuguacacgccccuccgggccaacaacgccggggacgacguguucaccgugagcugccgcguccugacccggcccaccccggacuucgaguucauguuccuggugccgcccaccguggaguccaagacgaagcccuucagccuccccucccugacccuggacgagcucagcaacucccgcuuccccgcccccaucguccagcuguacaccaacccccacgacaaccugguggugcagccgcagaacggccggugcaccaucgacggccuccugcaggggacgacccagcuggucagcugcaacgugugcuccuuccgcggcaccaucggggacggccagcccgccagccacuccgaggaggagaucaugcccauggcguucaacauccagcgggagaucaugcucgagaaccuggacggcagcccguacgaccccgccgacgacauccccgccguccuggggucccccgacuuccagggcaucguguucggggugcucagccagcgcaacgccgacggccagacccgggcccacgaggcgaaggucgacacgcgcgccgcccgguucgccccgaagcugggguucgugguggcgaccgucgaguccaccgacuuccacgccaaccagcccagccgcuucacccccgugggccugggcggggacggcaaccaggacuucaaccagugggcccuccccgccuacgggggcgcccugacgaacaacaccaaccuggcgccgcccgugaugcccgucuaccccggggagcagauccucuacuuccggagccagcugccguccagcggcggcguggucgggggcuggcuggacugccuccugccccaggagugggugcagcacuucuuccaggaguccgccaccagccaguccgacguggcccuggugcgcuacaucaaccccaccacggggcggguccucuucgaggccaagcugcacaagcagggcuuccugaccguggccgcgagcggguccuacccccucguggucccggccgacggcuacuuccgcuucgagagcugggugaaccaguucuacacccuggcccccaugggcaacggguccggccggcgccgcacccgguga

SEQ ID NO: 10369 - RNA, 1674 nt, Artificial Sequence
  derived and/or modified sequence opt1 from capsid_protein__Norovirus__AAX32877
augaugauggccagcaacgacgccaccgcgcccaccgacggcgccgccgggcuggugcccgaggucacgaacgagaccauggcccucgagcccguggccggcgcggcccuggccgcccccguggucgggcagcacaacgugaucgaccccuggauccgcggcaacuucgugcaggcgccgaacggggaguucaccgucagcccccggaacucccccggcgaggugcugcucaaccuggagcugggccccgagcucaacccguaccuggcccaccuggcccgcauguacaacggguacgccggcgggauggaggugcaggucgugcucgccggcaacgcguucgccgccgggaagaucaucuucgccgccgugccgcccuccuuccccgucgacgcgcugagcgcccccaccaucacgaugugcccccacgugaucguggacguccggcagcuggagcccgugcuccugcccaugccggacgugcgcaacaacuucuuccacuacaaccaguccagcgaccccaagcugcggcucgucgccaugcuguacacgccccugcgcgccaacucccccaccgacgacguguucaccgugagcugccggguccucacccgcccgucccccgacuucgaguucaccuuccugaucccgcccaccguggagagcaaguccaagcccuucaccaucccccagcugacgcucagcgagcuguccaacagccgguuccccgcccccaucgacaugcuguacaccuccccgaacgacaacaucgugguccagccccagaacggccgcugcacccucgacggcgagcugcaggggaccacgcagcugcagcccagccucaucugcuccuuccggggcgugacccugaacgagaccagccgcaugcuggucgaccaggaggaggaggaggagggggaggugcagcggccgcaggcgcgcgccuucaaccacgaguaccaccuccagcugcagaaccuggacggcaccgacuacgaccccgccggcgaccuccccgccacgcugggggcccccgacuucaucggcaccguguacggggucgugucccagcggaccacccgcgacagcgcggcccgggcccacgaggccaagaucacgaccagcgacccgcgcuacgcgcccaagcugggcuccguggaguucgucaccgagagcaccgacaucgugcucaacgaccagacgaaguucacccccguggggcuggcccacaaccgggccgucgacuacaagcagugggagcugccccacuacgccggcgagcucaccgccaacaccaaccuggcgccgcccguggcccccguguaccccggcgagcagcuccuguucuuccgcuccaaccugccgcuggccgggggcacggccgccagcguccucgacugccugcugccccaggaguggauccagcacuucuaccaggaguccuucgcgccccagagcgacaucgcccuccugcgguacgugaaccccgacaccgggcgcgugcuguucgaggccaagcugcaccgccagggcuacaucaccgucgccggggccggcaccuccccgguggcggugccgcccaacggcuacuuccgguucgagagcugggucucccaguucuacacgcucgcccccauggggagcggcaccgggcgccggcgcaaccaguga

SEQ ID NO: 10370 - RNA, 1674 nt, Artificial Sequence
  derived and/or modified sequence opt1 from capsid_protein__Norovirus__AAX32880
augaugauggccagcaacgacgccaccgcgcccaccgacggcgccgccgggcuggugcccgaggucacgaacgagaccauggcccucgagcccguggccggcgcggcccuggccgcccccguggucgggcagcacaacgugaucgaccccuggauccgcggcaacuucgugcaggcgccgaacggggaguucaccgucagcccccggaacucccccggcgaggugcugcucaaccuggagcugggccccgagcucaacccguaccuggcccaccuggcccgcauguacaacggguacgccggcgggauggaggugcaggucgugcucgccggcaacgcguucgccgccgggaagaucaucuucgccgccgugccgcccuccuuccccgucgacgcgcugagcgcccccaccaucacgaugugcccccacgugaucguggacguccggcagcuggagcccgugcuccugcccaugccggacgugcgcaacaacuucuuccacuacaaccaguccagcgaccccaagcugcggcucgucgccaugcuguacacgccccugcgcgccaacucccccaccgacgacguguucaccgugagcugccggguccucacccgcccgucccccgacuucgaguucaccuuccugaucccgcccaccguggagagcaaguccaagcccuucaccaucccccagcugacgcucagcgagcuguccaacagccgguuccccgcccccaucgacaugcuguacaccuccccgaacgacaacaucgugguccagccccagaacggccgcugcacccucggcggggagcugcagggcaccacgcagcugcagcccagccucaucugcuccuuccgcggggugacccugaacgagaccagccggaugcuggucgaccaggaggaggaggaggagggcgaggugcagcggccgcaggcgcgcgccuucaaccacgaguaccaccuccagcugcagaaccuggacggcaccgacuacgaccccgccggggaccuccccgccacgcugggcgcccccgacuucaucgggaccguguacggcgucgugucccagcggaccacccgcgacagcgcggcccgggcccacgaggccaagaucacgaccagcgacccgcgcuacgcgcccaagcugggguccguggaguucgucaccgagagcaccgacaucgugcucaacgaccagacgaaguucacccccgugggccuggcccacaaccgggccgucgacuacaagcagugggagcugccccacuacgccggcgagcucaccgccaacaccaaccuggcgccgcccguggcccccguguaccccggggagcagcuccuguucuuccgcuccaaccugccgcuggccggcgggacggccgccagcguccucgacugccugcugccccaggaguggauccagcacuucuaccaggaguccuucgcgccccagagcgacaucgcccuccugcgguacgugaaccccgacaccggccgcgugcuguucgaggccaagcugcaccgccagggguacaucaccgucgccggcgccggcaccuccccgguggcggugccgcccaacggguacuuccgguucgagagcugggucucccaguucuacacgcucgcccccaugggcagcgggaccggccgccggcgcaaccaguga

SEQ ID NO: 10371 - RNA, 1647 nt, Artificial Sequence
  derived and/or modified sequence opt1 from capsid_protein__Norovirus__AAX32886
augaagauggccagcuccgacgccgcgcccagcuccgacggcagcgccgggcuggugccggaggucaacuccgagaccauggcccucgagcccguggugggcgcgccccuggccgcccccgucgccgggcagcacaacaucaucgacccguggaucaagcugaacuucgugcaggcccccaacggcgaguucaccgugagcccccgcaacgcccccggggagauccuccuggaccuggagcucggcccggaccugaaccccuaccuggcgcaccucucccggauguacaacgccuacgccggcgggauggagguccaggugauccuggccggcaacgccuucacggcggggaagaucaucuucgccgccgugccgcccaacuucccccuggagaaccucagcgccgcccagaucaccaugugcccccacaucaucgucgacgugcgccagcuggagcccgugaugcugcccaugccggacguccggaaccgccucuuccacuacaaccaggugcgggagccccgccugcggcugguggcguaccucuacacgccccugcgcgccaacaacgccggcgacgacgucuucaccguguccugccgggugcugacccgccccagccaggacuucgaguucauguuccucgucccgcccuccguggagagcaagaccaagcccuucucccugcccaaccugacccucgccgagcugagcaacucccgguucccgcugcccaucgagcagcucuacaccaacccccuggacaaccuggugguccagccccagaacgggcgcugcacgaucgacggcauccuccugggcaccacccagcuggugccgagccucaucugcuccaugcgggggacccuggaggccgaccaggcgagcggccacacggacgacgaguccgugcagagccgcgccuucaaccggcagcgcagccugaugcucgagaaccccgacggguccgccuucgaccccagcgacgaggucccggccgugcugggcguccccgacuuccggggcgugguguucgggguccugucccagcgcaacaacggcgacaccacccggagccacgaggccaagaucgacacccgccggccccgcuacgcgcccaagcucggguucguggaggugcugacggaguccgacgacuuccagaacggcccgcccaccaaguucacccccgucgggcugggcggcgacgggaaccccgacuuccagcagugggcccucccggacuacggcggggcccugaccaacaacacgaaccuggccccgcccguggugcccgucuaccccggcgagcagauccucuucuuccgcagccagcugcccuccagcgggggcaccguggcgggcuggcuggacugccuccugccccaggaguggauccagcacuucuaccaggacuccgccgccgcccagagcgacguggcccugguccgguacaucaaccccgcgaccgggcgcgugcuguucgaggccaagcuccaccggcagggcuuccugaccguguccgccgccgggccgcaccccgucguggcccccgcggacggcuacuuccgcuucgagagcugggugaaccaguucuacacgcuggcccccauggggaacggcuccggccggcgccgggucuacuga

SEQ ID NO: 10372 - RNA, 1623 nt, Artificial Sequence
  derived and/or modified sequence opt1 from capsid_protein__Norovirus__AAZ31376
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggugcugagccccucccaggucaccauguucccccacaucaucguggacgugcggcagcuggagcccguccucaucccgcugcccgacgugcgcaacaaccuguaccacuacaaccagagcaacgaccccacgauccggcucaucgccaugcuguacacgccccugcgcgccaacaacgcgggggacgacguguucaccgucuccugccgggugcucacccgcccgagccccgacuucgacuucauguuccuggugccgcccaccgucgagucccggaccaagcccuucagcgugcccauccugaccguggaggagaugaccaacucccgcuuccccaucccccucgagaagcuguucacgggcccgagcuccgccuucgucgugcagccccagaacggccggugcaccaccgacgggguccugcucggcaccacgcagcugagccccgugaacaucugcaccuuccgcggggacgugacccacaucgccggcgcccagaacuacaccaugaaccuggccucccagaacuggaacaacuacgacccgacggaggagauccccgcgccccucggcacccccgacuucgucgggaagauccagggcgugcugacccagaccacgcggcgcgacgggagcacccggggccacaaggccaccguguccaccgggagcguccacuucacgccgaagcugggcagcgugcaguucuccaccgacaccagcaacgacuucgagaccggccagaacacgcgcuucacccccgugggggucgugcaggacggcuccaccacccaccagaacgagccccagcagugggugcuccccgacuacagcgggcgggacucccacaacguccaccuggccccggccguggcccccacguuccccggcgagcagcuccucuucuuccgcagcaccaugcccgggugcuccggcuacccgaacaugaaccuggacugccugcucccccaggagugggugcagcacuucuaccaggagagcgcgcccgcccaguccgacgucgcccugcugcgguucgugaaccccgacaccggccgcgugcuguucgagugcaagcugcacaagagcggguacgucaccguggcccacaccggccagcacgaccuggugaucccgcccaacggguacuuccgguucgacuccuggaucaaccaguucuacacgcucgcgcccaugggcaacggggccggccgccgccgggcccuguga

SEQ ID NO: 10373 - RNA, 1623 nt, Artificial Sequence
  derived and/or modified sequence opt1 from capsid_protein__Norovirus__AAZ31396
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggugcugagccccucccaggucaccauguucccccacaucaucguggacgugcggcagcuggagcccguccucaucccgcugcccgacgugcgcaacaaccuguaccacuacaaccagagcaacgaccccacgauccggcucaucgccaugcuguacacgccccugcgcgccaacaacgcgggggacgacguguucaccgucuccugccgggugcucacccgcccgagccccgacuucgacuucaucuuccuggugccgcccaccgucgagucccggaccaagcccuucagcgugcccauccugaccguggaggagaugaccaacucccgcuuccccaucccccucgagaagcuguucacgggcccgagcuccgccuucgucgugcagccccagaacggccggugcaccaccgacgggguccugcucggcaccacgcagcugagccccgugaacaucugcaccuuccgcggggacgugacccacaucgccggcacccagaacuacacgaugaaccuggccucccagaacuggaacaacuacgacccgaccgaggagauccccgcgccccucggcacccccgacuucgucgggcggauccagggcgugcugacccagacgacccgccgggacgggagcacccgcggccacaaggccaccguguccacggggagcguccacuucaccccgaagcugggcagcgugcaguucuccaccgacaccagcaacgacuucgagacgggccagaacacccgguucacccccgugggggucgugcaggacggcuccaccacgcaccagaacgagccccagcagugggugcuccccgacuacagcgggcgcgacucccacaacguccaccuggccccggccguggcccccaccuuccccggcgagcagcuccucuucuuccggagcaccaugcccgggugcuccggcuacccgaacaugaaccuggacugccugcucccccaggagugggugcagcacuucuaccaggagagcgcccccgcgcaguccgacgucgcccugcugcgcuucgugaaccccgacaccggccgggugcuguucgagugcaagcugcacaagagcggguacgucaccguggcccacacgggccagcacgaccuggugaucccgcccaacggguacuuccgcuucgacuccugggucaaccaguucuacacccucgcccccaugggcaacggggcgggccgccggcgcgcccuguga

SEQ ID NO: 10374 - RNA, 1623 nt, Artificial Sequence
  derived and/or modified sequence opt1 from capsid_protein__Norovirus__AAZ31402
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugggccccucccaggugaccauguucccccacaucaucgucgacgugcggcagcuggagcccgugcucaucccgcugcuggacguccgcaacaaccucuaccacuacaaccagagcaacgaccccaccaucaagcugaucgccaugcuguacacgccccuccgggccaacaacgcgggcgaggugguguucaccgucuccugccgcgugcugacccggcccagcccggacuucgacuucaucuuccuggugccgcccaccgucgagucccgcacgaagcccuucaccgugcccauccucaccgccgaggagaugaccaacagccgguuccccacgccccuggggaagcuguucaccggccccuccagcgccuucgugguccagccgcagaacgggcgcugcgccaccgacggcgugcuccugggcaccacgcagcugucccccgucaacaucugcaccuuccgcggggacgugacccacaucgccggcacccacgacuacacgaugaaccucgcgagccagaacuggaacaacuacgaccccaccgaggagaucccggcgccccuggggacccccgacuucgugggcaagauccaggggguccugacccagacgacccggggcgacggcuccacccgggggcacaaggccaccgugagcacgggcuccgugcacuucacccccaagcucgggggcguccaguucaccaccgacacgaacaacgacuucgagaccgggcagaacaccaaguucaccccggugggcgugauccaggacggcaacagcacgcaccagaacgagccccagcaguggguccugcccaacuacagcgggcgcaccggccacaacgugcaccuggcccccgccguggccccgaccuuccccggggagcagcuccuguucuuccgguccaccaugcccggcugcagcggguaccccaacaugaaccuggacugccuccugccgcaggaguggguccagcacuucuaccaggaggccgcccccgcccaguccgacguggcgcugcuccgcuucgugaaccccgacgccggccggguccuguucgagugcaagccccacaagagcggcuacgugaccguggcccacacggggcagcacgaccuggucaucccgcccaacggcuacuuccgcuucgacuccugggugaaccaguucugcacccucgcccccauggggaacggcaccggccggcgccgggcccuguga

SEQ ID NO: 10375 - RNA, 1620 nt, Artificial Sequence
  derived and/or modified sequence opt1 from capsid_protein__Norovirus__AAZ31411
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccccucccaccuggcccgcauguacaacggcuacgccgggggcuucgaggugcaggucauccuggccgggaacgccuucaccgccggcaagaucaucuucgccgccgugcccccgaacuuccccacggaggggcucagccccucccaggugaccauguucccccacaucaucgucgacgugcggcagcuggacccggugcugauccccagccccgacguccgcaacaacuucuaccacuacaaccaguccaacgacagcaccaucaagcucaucgccaugcuguacacgccccugcgggcgaacaacgccggcgacgacguguucaccguguccugccgcguccucacccggccgagccccgacuucgacuucaucuuccuggugccgcccaccguggagucccgcaccaagccguucacgguccccauccugaccguggaggagaugagcaacucccgguuccccaucccccucgagaagcuguacaccggcccgagcuccgccuucgugguccagccccagaacgggcgcugcaccacggacggcgugcugcucgggaccacccagcugagcgccgucaacaucugcaccuuccggggcgacgugacgcacaucgccggcucccacgacuacaccaugaaccuggcgagccagaacuggaucaacuacgaccccaccgaggagaucccggcgccccucgggacccccgacuucgugggcaagauccaggggaugcugacgcagaccacccgcgaggacggcagcacccgggcccacaaggccacggucuccaccgggagcgugcacuucacccccaagcugggcuccgugcaguacaccacggacaccaacaacgacuuccagaccggccaggacaccaaguucacgccggucggggugauccaggacggcaacaaccaccagaacgagccccagcagugggugcuccccaacuacagcgggcgcaccggccacaacguccaccuggcccccgccguggccccgaccuuccccggggagcagcuccuguucuuccgguccaccaugcccggcugcagcggcuaccccaacaugaaccuggacugccugcucccgcaggagugggugcagcacuucuaccaggaggccgcccccgcgcagcccgacgucgcccugcugcgcuucgugaaccccgacacggggcggguccucuucgagugcaagcugcacaaguccggcuacgugaccguggcccacaccgggccgcacgaccuggugaucccgcccaacggcuacuuccgcuucgacagcugggucaaccaguucuacacccucgcccccauggggaacggcgccggccggcgccgggcgcuguga

SEQ ID NO: 10376 - RNA, 1647 nt, Artificial Sequence
  derived and/or modified sequence opt1 from capsid_protein__Norovirus__AAZ31423
augaagauggccagcuccgacgccacccccagcaacgacggcgcggccgggcuggugccggagaucgacaacgaggccauggcccucgaccccgucgccggcgcggccaucgccgcgccccugaccgggcagcagaacaucaucgaccuguggaucaugaacaacuucgugcaggcccccggcggggaguucacgguguccccgcgcaacagccccggcgagguccuccugaaccuggagcucggccccgagaucaaccccuaccuggcccaccuggcccggaugcacaacggguacgccggcggguucgagguccagguggugcucgccggcaacgcguucaccgccgggaagaucaucuucgccgccaucccgcccaacuuccccaucgacaaccuguccgccgcgcagaucaccaugugcccccacgugaucguggacguccgccagcuggagccggugaaccuccccaugcccgacgugcggaacaacuucuuccacuacaaccagggcagcgacucccgccugcggcugaucgccaugcucuacacgccccugcgcgccaacaacagcggcgacgacgucuucaccguguccugccgggugcugacccgcccgagccccgacuucuccuucaacuuccucgucccgcccaccguggagagcaagaccaagcccuucacgcugcccauccugaccaucuccgagaugagcaacucccgguuccccgugcccaucgacagccuccugaccuccccgaccgagaacaucgucgugcagugccagaacgggcgcgugacgcuggacggcgagcucauggggaccacccagcugcugcccagccagaucugcgccuuccggggcguccucacccgcuccacgagccgggccagcgaccaggcggacaccgccacgccccgccuguucaacuacuacuggcacauccagcuggacaaccucaacggcacccccuacgacccggccgaggacauccccgggccccugggcaccccggacuuccgggggaagguguucggcguggccucccagcgcaaccccgacagcaccacccgggcccacgaggcgaaggucgacaccacggccgggcgcuucacccccaagcugggcucccucgagaucagcaccgaguccgacgacuucgaccagaaccagcccacccgguucacgccggugggcaucggggucgaccgcgaggccgacuuccagcaguggagccugcccgacuacuccggccaguucacccacaacaugaaccuggcccccgcgguggcccccaaccucccgggggagcagcugcuguucuuccggagccagcuccccuccagcggcgggcgcuccaccggcauccuggacugccuggugccccaggaguggguccagcacuucuaccaggagagcgcccccgcccagacccagguggcccucgugcgcuacaucaacccggacacgggccggguccuguucgaggcgaagcugcacaagcucggguucaugaccaucgccaagaacggcgacucccccaucaccgugccgcccaacggguacuuccgcuucgagagcugggugaaccccuucuacacccuggcccccaugggcacgggguccggccggcgccggauccaguga

SEQ ID NO: 10377 - RNA, 1623 nt, Artificial Sequence
  derived and/or modified sequence opt1 from capsid_protein__Norovirus__AAZ31428
augaagauggccagcaacgacgccgcgcccuccaacgacggcgccgccgggcuggugccggagaucaacaacgaggucaugccccucgagcccguggccggcgccagccuggcgacccccguggucgggcagcagaacaucaucgacccguggauccgcaacaacuucgugcaggcccccgccggcgaguucaccgugagcccccggaacucccccggggagauccugcucgaccuggagcugggcccggagcucaaccccuaccuggcccaccuggcgcgcauguacaacggccaccccuccgggauggaggagcagaucguccucgccggcaacgccuucacggccgggaagaucaucuucgccgcgaucccgcccggcuuccccuacgagaaccugagccccucccacaugaccaugugcccccacgugaucaucuacgugauccagcuggagccgguccucaugcugaugcccgagauccagaacaacuucuuccacuacaaccaggggaacgaccccaagcugcggcucguggccaugcuguacacgccccugcgcgccaacaacagcggcgacgacguguucaccgucuccugccgggugcucacgaagccgagccccgacuucgaguucaccuuccuggugccgcccaccgucgaguccaagaccaaggaguucacgcugcccauccuccgcaucagcgagaugaccaacucccgguuccccgugcccguggagaugauguacaccgcccgcaacgagaaccaggucgugcagccccagaacggccgggugacccuggacggggagcugcucggcacgaccccgcugcuggccgucaacaucugcaaguucaagggggaggugaucgcgaagaacggcgacgugcgcagcuaccggauggacauggagaucaccaacaccgacggcacgcccaucgaccccaccgaggacaccccggggcccaucggcucccccgacuuccaggggauccucuucggcgucgccagccagcgcaacaagaacgagcagaaccccgccacccgggcccacgaggugaacaucaacaccgggggcgaccaguacgccccgaagcuggcgcaggucaaguucuucuccgagagccaggacuucgaggugcaccagcccaccguguucacccccgucggcguggccggggacaccucccaccccuuccgccagugggugcugccgcgguacggcgggcaccucacgaacaacacccaccuggcccccgccgucgcgccccuguuccccggcgagcagauccucuucuuccgcagccagaucccgagcuccgggggccacgagcugggcuacauggacugccuggugccccaggagugggugcagcacuucuaccaggaggccgccaccgcccagagcgaggucgcccucauccgguucaucaaccccgacaccgggcgcgugcuguucgaggcgaagcugcacaagcagggcuucaucacgguggcccacaccggggacaaccccaucgucaugccgcccaacggcuacuuccgguucgaggccugggugaaccaguucuacucccucgcccccguggggaccggcaacggccgccggcgcguccaguga

SEQ ID NO: 10378 - RNA, 1626 nt, Artificial Sequence
  derived and/or modified sequence opt1 from capsid_protein__Norovirus__ABB02420
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugcuccagccccgccugugcacccacgcccgguggcccgccccggucuacggccugcucguggaccccagccugcccuccaacccccaguggcagaacgggcgcgugcacgucgacggcacccugcucggcaccaccccggugagcggguccugggucagcugcuucgcggccgaggccgccuacgaguuccaguccggcaccggccagguggccacguucaccaugaucgagcaggacgggagcgcguacgugcccggggaccgggccgcgccccugggcuacccggacuacuccggccagcuggagaucgagguccagaccgagaccacgaaggccggggacaagcucaaggugaccaccuucgagaugauccugggccccaccacgaacguggaccaggcccccuaccaggggcgcgccuacgccagccugaccgccgucgccagccucgaccugguggacggccgggugcgcgcggucccccgguccaucuacagcuuccaggacgugcugccggaguacaacgacgggcuccuggugccccuggccccgccccucggccccuuccugcccggcgagguccugcuccgcuuccggaccuacaugcgccagcuggacaccgccgacgccgccgcgcagcccaucgacugcgcccugccccaggaguucaucuccugguucgccagcaacuccuucacggugcagagcgacgcccuccuggugcgguaccgcaacacccugaccgggcagcuccuguucgaggccaagcuguacuccgagggcuacaucgcggucagcuacuccgggagcggcccgcugaccuuccccacggacggguucuucgaggugguguccugggucccccgccucuuccagcuggccagcgugggcucccuggccaccggccggacccucaagcaguga

SEQ ID NO: 10379 - RNA, 1626 nt, Artificial Sequence
  derived and/or modified sequence opt1 from capsid_protein__Norovirus__ABB02423
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccagcgacuucaacuucgucuaccugacgcccccgaucgagcgcaccaucuaccggaugguggaccugcccgugcuccagccccgccugugcacccacgcccgguggcccgccccggucuacggccugcucguggaccccucccugcccagcaacccccaguggcagaacgggcgcgugcacgucgacggcacccugcucggcaccaccccgguguccgggagcugggucuccugcuucgccgcggaggccgccuacgaguuccagagcggcaccggggagguggccacguucaccaugaucgagcaggacggcuccgccuacgugcccggggaccgggcggcgccccugggcuacccggacuucagcggccagcuggagaucgagguccagaccgagaccacgaagaccggggacaagcucaaggugaccaccuucgagaugauccugggccccacgaccaacguggaccaggcccccuaccaggggcgcgccuacgccagccugaccgccgccgccucccucgaccuggucgacggccgggugcgcgccgugccccggagcgucuacuccuuccaggacgagcugccggaguacaacgacgggcuccuggugccccuggcgccgccccucggccccuuccugcccggcgaggugcugcuccgcuuccggaccuacaugcgccagcuggacacggccgacgccagcgcccagcccaucgacugcgcccugccccaggaguucaucuccugguucgcgagcaacaacuucaccguccaguccgacgcccuccuggugcgguaccgcaacacccugaccgggcagcuccuguucgaggccaagcuguacagcgagggcuacaucgccguguccuacagcggguccggcccgcugacguuccccaccgacggguucuucgaggucgugagcugggugccccgccucuuccagcuggccuccgucggcagccuggugaccggccggacccucaagcaguga

SEQ ID NO: 10380 - RNA, 1623 nt, Artificial Sequence
  derived and/or modified sequence opt1 from capsid_protein__Norovirus__ABC96746
augaagauggccagcaacgacgccuccagcuccgacggcagcaccgcgaaccuggugcccgaggucaacaacgaggugauggcccucgagccgguggucggggccgccaucgccgcgcccguggccggccagcagaacgugaucgaccccuggauccgcaacaacuucguccaggcccccgggggcgaguucaccguguccccgcggaacgcccccggggagauccuguggagcgcgccccugggccccgaccucaacccguaccugucccaccuggcccgcauguacaacggcuacgccgggggcuucgaggugcaggucauccucgccgggaacgccuucacggcgggcaagaucaucuucgccgccgugccgcccaacuuccccaccgaggggcugagccccucccaggugaccauguucccccacaucaucgucgacgugcggcagcuggagcccgugcucaucccccugccggacguccgcaacaacuucuaccacuacaaccagagcaacgaccccaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucgccggcacccacgacuacacgaugaaccuggccagccagaacuggaacaacuacgaccccaccgaggagaucccggcgccccuggggacccccgacuucgugggcaagauccaggggguccucacccagacgacccgcggcgacggguccacccggggccacaaggccaccgugagcacgggcagcgugcacuucacccccaagcugggguccguccaguucaccaccgacacgaacaacgacuucgagaccggccagaacaccaaguucaccccggugggggugguccaggacggcaacagcacgcaccagaacgagccccagcagugggugcugcccaacuacuccgggcgcaccggccacaacgugcaccucgcccccgccgucgccccgaccuuccccggcgagcagcugcuguucuuccggagcaccaugcccgggugcuccggcuaccccaacaugaaccucgacugccugcugccgcaggagugggugcagcacuucuaccaggaggccgcgcccgcccagagcgacguggcccuccugcgcuucgucaaccccgacaccgggcgggugcuguucgagugcaagcuccacaaguccggcuacgugacggucgcccacaccgggcagcacgaccuggugaucccgcccaacggcuacuuccgcuucgacagcugggugaaccaguucuacacccuggcgcccaugggcaacggggccggccggcgccgggcccucuga

SEQ ID NO: 10381 - RNA, 1620 nt, Artificial Sequence
  derived and/or modified sequence opt1 from capsid_protein__Norovirus__ABD77588
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacagcuccguccaggcccccgggggcgaguucaccgugagcccccgggacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgccccgcccaacuucccgaccgaggggcugucccccagccaggugaccauguucccccacaucaucgugggcguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcacgaagcccuucaccgugcccauccugaccgucgaggagaugaccaacagccgguuccccaucccccuggagaacugcucccgcgugcccgccgugccgcucagcuccaaccacaagaugcagugcacgaccgacgggguccugcugggcaccacccagcucagccccgugaacaucugcacguuccgcggggacgucacccacauccccggcacccggaccuaccggaugaaccuggccagccagaacuggaacaacuacgacccgacggaggagauccccgcgccccugggcacccccgacuucguggggaagauccagggcaugcucacccagaccacgaagggggacggcuccacccgcgggcacaaggccaccgugagcaccggcuccgucgacuucacgccgaagcugggcagcgugcaguucgccaccgacaccgacaacgacuucgagaccgggcagaacacgcgguucacccccgugggcgucauccaggacggguccagcacccaccgcaacgagccccagcagugggugcugcccgacuacuccggccggaccgugcacaacguccaccucgccccggccguggcccccacguuccccggggagcagcugcuguucuuccgcagcaccaugcccggcugcuccggcuacccgaacauggaccucgacugccugcugccccaggagugggugcagcacuucuaccaggaggcggcccccagccaguccgacgucgcccuccugcgguucgugaaccccgacaccgggcgcgugcuguucgagugcaagcuccacaaggccggcuacgucaccguggcgcacaccgggcagcacgaccuggugaucccgcccaacggcuacuuccgguucgacagcugggucaaccaguucuacacgcuggcccccauggggaacggcgccggccgccgccgggcccucuga

SEQ ID NO: 10382 - RNA, 1623 nt, Artificial Sequence
  derived and/or modified sequence opt1 from capsid_protein__Norovirus__ABD77589
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgucagcacgggcagcguggacuucaccccgaagcuggacuccgugcaguucgccaccgacaccgacaacgacuucgagacggggcagaacacccgguucacccccgucggcgugauccaggacgggagcuccgcccaccgcaacgagccccagcagugggugcugcccgacuacagcggccggaccguccacaacgugcaccucgccccggccguggcccccacguuccccggggagcagcugcuguucuuccgcuccaccaugcccggcugcagcggcuacccgaacauggaccucgacugccugcugccccaggaguggguccagcacuucuaccaggaggcggcccccucccagagcgacguggcccuccugcgguucgugaaccccgacaccgggcgcguccuguucgagugcaagcuccacaaggccggcuacgugaccguggcgcacaccgggcagcacgaccuggucaucccgcccaacggcuacuuccgguucgacuccugggugaaccaguucuacacgcuggcccccauggggaacggcgccggccgccgccgggcccucuga

SEQ ID NO: 10383 - RNA, 1647 nt, Artificial Sequence
  derived and/or modified sequence opt1 from capsid_protein__Norovirus__ABD77590
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccagguggugcuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagcaagcuccgccuggucgccaugcuguacaccccgcuccgggccaacaacuccggcgacgacguguucacggugagcugccgcguccugacccggcccucccccgacuucagcuucaacuuccuggugcccccgaccguggaguccaagaccaagcccuucacgcuccccauccugaccaucagcgagauguccaacagccgcuuccccgucccgaucgacucccugcacaccagccccaccgagaacaucuccgugcagugccagaacgggcgggugacgcucgacggcgagcugauggggaccacccagcugcuccccagccagaucugcgccuuccgcggcguccugacccgguccacgagccgcgccagcgaccaggcggacaccgccacgccccggcuguucaacuacuacuggcacauccagcucgacaaccugaacggcaccccguacgaccccgccgaggacauccccgggccgcugggcacccccgacuuccgcgggaagguguucggcguggccucccagcggaaccccgacagcaccacccgcgcccacgaggcgaaggucgacaccacggccgggcgguucacccccaagcucggcucccuggagaucagcaccgaguccggcgacuucgaccagaaccagccgacccgcuucacgcccguggggaucggcgucgaccacgaggagaacuuccagcaguggagccugcccgacuacuccgggcaguucacccacaacaugaaccucgcccccgccguggcgccgaacuuccccggcgagcagcugcuguucuuccggagccagcuccccuccagcgggggccgcuccaacggcauccuggacugccuggugccccaggaguggguccagcacuucuaccaggagagcgccccggcccagacccagguggcccucgugcgguacgucaaccccgacaccgggcgcgugcuguucgaggccaagcugcacaagcucggcuucaugacgaucgcgaagaacggggacucccccaucaccgugcccccgaacggcuacuuccgcuucgagagcugggucaaccccuucuacacccuggcccccauggggaccggcaacggccggcgccggauccaguga

SEQ ID NO: 10384 - RNA, 1626 nt, Artificial Sequence
  derived and/or modified sequence opt1 from capsid_protein__Norovirus__ABG45845
augcgcaugagcgacggcgccgcccccaaggcgaacggguccgaggccagcggccaggaccuggugccgaccgccgucgagcaggccgugcccauccagcccguggccggggcgucccucgccgcccccgccgcgggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgccggcaacgcguucaccgccgggaaggugguggucgcccuggugccgcccuacuuccccaagggcucccugaccaccgcccagaucacgugcuucccccacgugaugugcgacguccgcacccucgagcccauccagcugccccugcucgacgugcggcgcgugcuguggcacgccacccaggaccaggaggagagcaugcggcuggucugcaugcucuacaccccgcugcgcacgaacucccccggcgacgagagcuucgugguguccgggcggcugcucagcaagcccgcggccgacuucaacuucgucuaccugacgcccccgaucgagcgcaccaucuaccggaugguggaccugcccgugcuccagccccgccugugcacccacgcccgguggcccgccccgaucuacggccugcucgucgaccccucccugcccgccaacccccaguggcagaacgggcgcgugcacguggacggcacccugcucggcaccaccccggucagcggguccugggugagcugcuucgcggccgaggccgccuacgaguuccaguccggcaccggggaggucgccacguucacccugaucgagcaggacggcagcgcguacgugcccggggaccgggccgcgccccugggcuacccggacuucuccggccagcucgagaucgaggugcagaccgagaccacgaagaccggggacaagcugaccgucaccacguucgagaugauccugggccccaccaccaacguggaccaggcccccuuccaggggcgcgccuacgccagccucaccgccgccgccagccuggaccugguggacggccggguccgcgcggugccccgguccaucuacagcuuccaggacgugaucccggaguacaacgacgggcuccuggucccccuggccccgcccaucggccccuuccuccccggcgaggugcugcugcgcuuccggacguacaugcgccagaucgacuccagcgacgccgccgccgaggcgaucgacugcgcccucccccaggaguucaucuccugguucgccagcaacgccuucaccgugcaguccgaggcccugcugcuccgguaccgcaacacccugaccgggcagcugcuguucgagugcaagcucuacagcgagggcuacaucgcgcuguccuacagcggguccggcccccugacguucccgaccgacggguucuucgaggucgugagcugggugccccgccucuaccagcuggccuccgucggcagccuggccaccggccggacccucaagcaguga

SEQ ID NO: 10385 - RNA, 1626 nt, Artificial Sequence
  derived and/or modified sequence opt1 from capsid_protein__Norovirus__ABG45847
augcgcaugagcgacggcgccgcccccaaggcgaacggguccgaggccagcggccaggaccuggugccgaccgcccucgagcaggccguccccauccagcccguggccggggcgucccuggccgcccccgccgcgggccagaucaaccagaucgacccguggaucuuccagaacuucgugcagugcccccugggggaguucagcaucagcccccggaacacccccggcgagauccucuucgaccuggcccugggcccggggcucaaccccuaccuggcccaccuguccgccauguacacgggcugggucgggaacauggaggugcagcucgugcuggccggcaacgcguucaccgccgggaaggucgugguggcccuggucccgcccuacuuccccaagggcucccucaccaccgcccagaucacgugcuucccccacgugaugugcgacgugcgcacccuggagcccauccagcugccccuccuggacguccggcgcgugcuguggcacgccacccaggaccaggaggagagcaugcggcucgugugcaugcuguacaccccgcugcgcacgaacucccccggcgacgagagcuucgucguguccgggcggcuccugagcaagcccgcggccgacuucaacuucguguaccugacgcccccgaucgagcgcaccaucuaccggauggucgaccuccccgugcugcagccccgccugugcacccacgcccgguggcccgccccgaucuacggccuccugguggaccccucccugcccgccaacccccaguggcagaacgggcgcguccacguggacggcacccuccugggcaccaccccggugagcggguccugggucagcugcuucgcggccgaggccgccuacgaguuccaguccggcaccggggagguggccgcguucacgcugaucgagcaggacggcagcgccuacguccccggggaccgggccgcgccccucggcuacccggacuucuccggccagcuggagaucgaggugcagaccgagaccaccaagacgggggacaagcugaccgugaccaccuucgagaugauccucggccccacgaccaacgucgaccaggcccccuuccaggggcgcguguacgccagccugaccgccgccgccagccuggaccucguggacggccggguccgcgcggugccccgguccaucuacggguuccaggacgugaucccggaguacaacgacggccugcuggucccccucgccccgcccaucggccccuuccugcccggggaggugcugcuccgcuuccggaccuacaugcgccagaucgacagcuccgacgccgccgccgaggcgaucgacugcgcccugccccaggaguucaucagcugguucgccuccaacgccuucacggugcagagcgaggcccugcuccugcgguaccgcaacacccugaccggccagcuccuguucgagugcaagcuguacuccgagggguacaucgcgcugagcuacuccggcagcgggccccucaccuucccgacggacggcuucuucgaggucguguccugggugccccgccuguaccagcuggccagcgucggcucccucgccaccgggcggacccugaagcaguga

SEQ ID NO: 10386 - RNA, 1626 nt, Artificial Sequence
  derived and/or modified sequence opt1 from capsid_protein__Norovirus__ABG45849
augcgcaugagcgacggcgccgcccccaaggcgaacggguccgaggccagcggccaggaccuggugccgaccgccgucgagcaggccgugcccauccagcccguggccggggcgucccucgccgcccccgccgcgggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgccggcaacgcguucaccgccgggaaggugguggucgcccuggugccgcccuacuucccccgcggcucccugaccaccgcccagaucacgugcuucccccacgugaugugcgacguccggacccucgagcccauccagcugccccugcucgacgugcgccgggugcuguggcacgccacccaggaccaggaggagagcaugcgccuggucugcaugcucuacaccccgcugcggacgaacucccccggcgacgagagcuucgugguguccgggcgccugcucagcaagcccgcggccgacuucaacuucgucuaccugacgcccccgaucgagcggaccaucuaccgcaugguggaccugcccgugcuccagccccggcugugcacccacgcccgcuggcccgccccgaucuacggccugcucgucgggcccucccugcccgccaacccccaguggcagaacggccgggugcacguggacggcacccugcucgggaccaccccggucagcggcuccugggugagcugcuucgcggccgaggccgccuacgaguuccaguccgggaccggcgaggucgccgcguucacgcugaucgagcaggacgggagcgccuacgugcccggcgaccgcgccgcgccccugggcuacccggacuucuccgggcagcucgagaucgaggugcagaccgagaccaccaagacgggcgacaagcugaccgucaccaccuucgagaugauccuggggcccacgaccaacguggaccaggcccccuuccagggccggguguacgccagccucaccgccgccgccagccuggaccuggucgacgggcgcgugcgggcggugccccgcuccaucuacggcuuccaggacgucaucccggaguacaacgacggccuccuggugccccuggccccgcccaucgggcccuuccuccccggcgaggugcugcugcgguuccgcaccuacaugcggcagaucgacagcuccgacgccgccgccgaggcgaucgacugcgcccucccccaggaguucaucagcugguucgccuccaacgccuucacgguccagagcgaggcccugcugcuccgcuaccgcaacacccugaccgagcagcugcuguucgagugcaagcucuacuccgagggguacaucgcgcugagcuacuccggcagcgggccccugaccuucccgacggacggcuucuucgaggccguguccugggugccccggcucuaccagcuggccagcgucggcucccuggccaccgggcgcacccucaagcaguga

SEQ ID NO: 10387 - RNA, 1626 nt, Artificial Sequence
  derived and/or modified sequence opt1 from capsid_protein__Norovirus__ABG45851
augcgcaugagcgacggcgccgcccccaaggcgaacggguccgaggccagcggccaggaccuggugccgaccgccgucgagcaggccgugcccauccagcccguggccggggcgucccucgccgcccccgccgcgggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgccggcaacgcguucaccgccgggaagguggccguggcccuggucccgcccuacuuccccaagggcucccugaccaccgcccagaucacgugcuucccccacgugaugugcgacgugcgcacccucgagcccauccagcugccccugcucgacguccggcgcgugcuguggcacgcgacccaggaccaggaggagagcaugcggcuggugugcaugcucuacaccccgcugcgcacgaacucccccggcgacgagagcuucgucguguccgggcggcugcucagcaagcccgccgccgacuucaacuucguguaccugacgcccccgaucgagcgcaccaucuaccggauggucgaccugcccgugcuccagccccgccugugcacccacgcccgguggcccgccccgaucuacggccugcucguggaccccucccugcccgcgaacccccaguggcagaacgggcgcguccacguggacggcacccugcucggcaccaccccggugagcgggucccgggucagcugcuucgccgccgaggccgccuacgaguuccaguccggcaccggggagguggcgacguucacccugaucgagcaggacggcagcgccuacguccccggggaccgcgccgcgccccugggcuacccggacuucuccggccagcucgagaucgaggugcagaccgagaccacgaagaccggggacaagcugaccgugaccacguucgagaugauccugggccccaccaccaacgucgaccaggcccccuuccaggggcgggccuacgccagccucaccgccgccgcgagccuggaccugguggacggccgcgugcgggccgucccccgcuccaucuacagcuuccaggacgugaucccggaguacaacgacgggcuccuggugccccuggccccgcccaucggccccuuccuccccggcgagguccugcugcgguuccgcacguacaugcggcagaucgacuccagcgacgccgccgcggaggccaucgacugcgcccucccccaggaguucaucuccugguucgccagcaacgccuucaccgugcaguccgaggcgcugcugcuccgcuaccgcaacacccugaccgggcagcugcuguucgagugcaagcucuacagcgagggcuacaucgcccuguccuacagcggguccggcccccugacguucccgaccgacggguucuucgagguggucagcugggugccccggcucuaccagcuggccuccgugggcagccuggccaccggccgcacccucaagcaguga

SEQ ID NO: 10388 - RNA, 1626 nt, Artificial Sequence
  derived and/or modified sequence opt1 from capsid_protein__Norovirus__ABI95835
augcgcaugagcgacggcgccgcccccaaggcgaacggguccgaggccagcggccaggaccuggugccgaccgccgucgagcaggccgugcccauccagcccguggccggggcgucccucgccgcccccgccgcgggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgccggcaacgcguucaccgccgggaaggugguggucgcccuggugccgcccuacuuccccaagggcucccugaccaccgcccagaucacgugcuucccccacgugaugugcgacguccgcacccucgagcccauccagcugccccugcucgacgugcggcgcgugcuguggcacgccacccaggaccaggaggagagcaugcggcuggucugcaugcucuacaccccgcugcgcacgaacucccccggcgacgagagcuucgugguguccgggcggcugcucagcaagcccgcggccgacuucaacuucgucuaccugacgcccccgaucgagcgcaccaucuaccggaugguggaccugcccgugcuccagccccgccugugcacccacgcccgguggcccgccccgaucuacggccugcucgucgaccccucccugcccgccaacccccaguggcagaacgggcgcgugcacguggacggcacccugcucggcaccaccccggucagcggguccugggugagcugcuucgcggccgaggccgccuacgaguuccaguccggcaccggggaggucgccacguucacccugaucgagcaggacggcagcgcguacgugcccggggaccgggccgcgccccugggcuacccggacuucuccggccagcucgagaucgaggugcagaccgagaccacgaagaccggggacaagcugaccgucaccacguucgagaugauccugggccccaccaccaacguggaccaggcccccuuccaggggcgcgccuacgccagccucaccgccgccgccagccuggaccugguggacggccggguccgcgcggugccccgguccaucuacagcuuccaggacgugaucccggaguacaacgacgggcuccuggucccccuggccccgcccaucggccccuuccuccccggcgaggugcugcugcgcuuccggacguacaugcgccagaucgacuccagcgacgccgccgccgaggcgaucgacugcgcccucccccaggaguucaucuccugguucgccagcaacgccuucaccgugcaguccgaggcccugcugcuccgguaccgcaacacccugaccgggcagcugcuguucgagugcaagcucuacagcgagggcuacaucgcgcuguccuacagcggguccggcccccugaucuucccgacggacggguucuucgaggucgugagcugggugccccgccucuaccagcuggccuccgucggcagccuggccaccggccggacccucaagcaguga

SEQ ID NO: 10389 - RNA, 1620 nt, Artificial Sequence
  derived and/or modified sequence opt1 from capsid_protein__Norovirus__ABI97981
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcacguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcaccaagcccuucaccguccccauccugaccguggaggagauguccaacagccgguuccccaucccccuggagaagcucuacacgggccccuccagcgccuucgugguccagccgcagaacgggcgcugcaccaccgacggcgugcugcuggggaccacgcagcucuccgccgucaacaucugcaccuuccggggcgacgugacccacaucgccggcagccacgacuacaccaugaaccuggccucccagaacuggaacaacuacgaccccacggaggagauccccgcgccgcuggggacccccgacuucgugggcaagauccaggggaugcucacccagaccacgcgcgaggacggcagcacccgggcccacaaggccaccgucagcaccggguccgugcacuucacgcccaagcugggcagcgugcaguacaccaccgacaccaacaacgacuuccagacgggccagaacaccaaguucacccccgucggggugauccaggacggcaacaaccaccagaacgagccgcagcagugggugcugcccaacuacuccgggcgcaccggccacaacguccaccucgcccccgccguggcgcccacguucccgggggagcagcugcuguucuuccggagcaccaugcccggcugcuccggcuaccccaacaugaaccucgacugccugcugccccaggagugggugcagcacuucuaccaggaggccgccccggcccagagcgacgucgcgcuccugcgcuucgugaaccccgacaccgggcgggugcuguucgagugcaagcuccacaaguccggcuacgucaccguggcccacaccgggccccacgaccuggugaucccgcccaacggcuacuuccgcuucgacagcugggucaaccaguucuacacgcuggcccccauggggaacggcgccggccggcgccgggcccucuga

SEQ ID NO: 10390 - RNA, 1626 nt, Artificial Sequence
  derived and/or modified sequence opt1 from capsid_protein__Norovirus__ABP99038
augcgcaugagcgacggcgccgcccccaaggcgaacggguccgaggccagcggccaggaccuggugccgaccgccgucgagcaggccgugcccauccagcccguggccggggcgucccucgccgcccccgccgcgggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgccggcaacgcguucaccgccgggaaggugguggucgcccuggugccgcccuacuuccccaagggcucccugaccaccgcccagaucacgugcuucccccacgugaugugcgacguccgcacccucgagcccauccagcugccccugcucgacgugcggcgcgugcuguggcacgccacccaggaccaggaggagagcaugcggcuggucugcaugcucuacaccccgcugcgcacgaacucccccggcgacgagagcuucgugguguccgggcggcugcucagcaagcccgcggccgacuucaacuucgucuaccugacgcccccgaucgagcgcaccaucuaccggaugguggaccugcccgcccuccagccccgccugugcacccacgcccgguggcccgccccgguguacggccugcucgucgaccccucccugcccagcagcccccaguggcagaacgggcgcgugcacguggacggcacccugcucggcaccaccccggucuccggguccugggugagcugcuucgcggccgaggccgccuacgaguuccaguccggcaccggggaggucgccacgagcacccugaucgagcaggacggcagcgcguacgugcccggggagcgggccgcgccccugggcuacccggacuucuccggccagcucgagaucgaggugcagaccgagaccacgaaggccggggacaagcugcgcgucaccaccuucgagaugauccugggccccaccacgaacguggaccaggcccccuaccaggggcggguguacgccagccucaccgccgccgccucccuggaccuggucgacggccgcgugcgggcggugccccgcagcaucuacggguuccaggacgucaucccggaguacaacgacggccuccuggugccccuggccccgcccaucggccccuuccuccccggggaggugcugcugcgguuccgcaccuacaugcggcagaucgacuccagcgacgccgccgccgaggcgaucgacugcgcccucccccaggaguucaucuccugguucgccagcaacgccuucaccguccaguccgaggcccugcugcuccgcuaccgcaacacgcugaccggccagcugcuguucgagugcaagcucuacagcgagggguacaucgcgcuguccuacagcggcuccgggccccuggccuucccgaccgacggcuucuucgagguggugagcugggucccccggcucuaccagcuggccuccgugggcagccuggccaccgggcgcacgcucaagcaguga

SEQ ID NO: 10391 - RNA, 1626 nt, Artificial Sequence
  derived and/or modified sequence opt1 from capsid_protein__Norovirus__ABP99041
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugcuccagccccgccugugcacccacgcccgguggcccgccccggucuacggccugcucguggaccccagccugcccuccaacccccaguggcagaacgggcgcgugcacgucgacggcacccugcucggcaccaccccggugagcggguccugggucagcugcuucgcggccgaggccgccuacgaguuccaguccggcaccggggagguggccacguucaccaugaucgagcaggacggcagcgcguacgugcccggggaccgggccgcgccccugggcuacccggacuucuccggccagcuggagaucgagguccagaccgagaccacgaaggccggggacaagcucaaggugaccaccuucgacaugauccugggccccaccacgaacguggaccaggcccccuaccaggggcgcgccuacgccagccugaccgccgccgcgagccucgaccuggucgacggccgggugcgcgccgugccccgguccaucuacagcuuccaggacgagcugccggaguacaacgacgggcuccuggucccccuggccccgccccucggccccuuccugcccggcgaggugcugcuccgcuuccggaccuacaugcgccagcuggacaccgccgacgccuccgcgcagcccaucgacugcgcccugccccaggaguucaucagcugguucgccuccaacaacuucacggugcagagcgacgcccuccugguccgguaccgcaacacccugaccgggcagcuccuguucgaggccaagcuguacuccgagggcuacaucgcggugagcuacuccgggagcggcccgcugaccuuccccacggacggguucuucgagguggucuccugggugccccgccucuuccagcuggccagcgugggcucccuggccaccggccggacccucaagcaguga

SEQ ID NO: 10392 - RNA, 1623 nt, Artificial Sequence
  derived and/or modified sequence opt1 from capsid_protein__Norovirus__ABQ12784
augaagauggccagcaacgacgccacccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucacggccggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggcgaacaacgccggcgacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccagcuucgugguccagccccagaacgggcgcugcacgaccgacggcgugcuccuggggaccacccagcucucccccgucaacaucugcacguuccggggcgacgugacccacaucgccggcacccagaacuacaccaugaaccuggccagccagaacuggaacaacuacgacccgacggaggagauccccgcgccccuggggacccccgacuucgugggcaagauccaggggguccucacccagaccacgcgccgggacggcuccacccgcgggcacaaggccaccgugagcaccggcagcgugcacuucacgccgaagcugggcuccguccaguucagcaccgacaccuccaacgacuucgagaccgggcagaacacgcgguucacccccgugggcgugguccaggacgggagcaccacgccccagaacgagccccagcagugggugcugccggacuacuccggccgcgacagccacaacgugcaccucgcccccgccgucgcccccaccuuccccggggagcagcugcuguucuuccgguccaccaugccgggcugcagcggcuaccccaacaugaaccucgacugccugcugccccaggagugggugcagcacuucuaccaggaguccgcccccgcgcagagcgacguggcccuccugcgcuucgucaacccggacaccgggcgggugcuguucgagugcaagcuccacaaguccggcuacgugaccgucgcccacaccgggcagcacgaccuggugaucccgcccaacggcuacuuccgcuucgacagcugggugaaccaguucuacacgcuggcccccauggggaacggcgcgggccggcgccgcgcccucuga

SEQ ID NO: 10393 - RNA, 1737 nt, Artificial Sequence
  derived and/or modified sequence opt1 from capsid_protein__Norovirus__ABR15783
augaagauggccagcuccgacgccacccccagcuccgacggcgcggggaaccuggugccggagagccagcaggagguccucccccuggcccccguggccggcgccgcccuggcggcccccguggucgggcagcagaacaucaucgacccguggaucaaggagaacuucgugcaggcgccccagggcgaguucaccgugucccccaagaacagccccggggagguccucgugaaccuggagcuguccccgcgccucaaccccuaccugcaccaccugagcaagauguacaacgccuacgccggcggcauggagguggagaucauccucgccgggaacgccuucacggccggcaagguccugaucgccgcggugccgcccaacuuccccaucgagaacguguccgccagccaggccucccaguucccccacgucaucguggacgugcggacccuggagcccauccgccucccccugccggacguccggaccaacuucuuccacuacaccacgcaggaggagccccgcaugcggaucguggccuggcuguacacgccccuccgcaccaacgggagcggcgacgacuccuucaccgugagcgggcggauccugacccgccccuccccggacuucgaguucagcuuccuggucccgcccaccguggagaccaagaccguguccuucagcguccccggccucguggugcaggacauguccaacagccgguggcccgcccagaucagcggccuggucgugcgcgggaacgaggcgcaggucgugcacuuccagaacggccggugcacgaccgaggggaugcugcucggcaccaccacgcugaacaucaacuccaucugcggccugcgcgggcucagcgugucccaggccagcguccggggcgcccccgcccugaccgaggagaugccgccccuggaggacgagguggccgacggggcggccgccaccuacacccucacgcgcgccgccgacaccgcgcuguggcugcggguggaggagcccgacggccgccccuacgacaucuucggggaccagcccgccccgcucggcacccccgacuucaccgccgucaucgugggcacggccauccggccccgcaccaccuccggggcguaccugcacgacgccuacguggacaccacgcccggcgacgccgacuucaccccgagcaccgggaacaccaagaucguccugcggggcgggggcuccggccacguggggcagggccacuacuggcaguucaagcccaucgccguggagggcggcgggagccgcccccaguaccaggaguacaaccuccccgacuacgccgggccgacggcguccaaccacgaccuggccccgcccgucgcgccccggaugcccggcgagcugcuccugcuguucgagagcgacaugcccgugugggacaacggggccggcgccgcccccgcccagaagauccacugccuccugcccaacgaguucaucacccaccuguucgaccuccaggccccggcccuggccgaggcggcccugcuccgcuacgugcaccccgacuccgggcgcacccuguucgagugcaagcuguaccgggagggcuacauggucguggccgcccccgugggccgccucaacuucccccuggacggguacuuccgguucgacagcugggucuccgcguucuacgugcugagcccggugggcuccgggcagggccgccgggggcgcagcaaggccgccuga

SEQ ID NO: 10394 - RNA, 807 nt, Artificial Sequence
  derived and/or modified sequence opt1 from capsid_protein__Norovirus__ABR24136
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuucgaguucagcuccaaccugcagcaggccagcuuccagcacgacaaggagaugcugcaggcccagaucgaggccaccaagaagcuccagcagggcaugaugaaggugaagcaggcgaugcugcuggagggcggguucuccgagaccgacgccgcccgcggggccaucaacgcccccaugacgaaggcgcucgacuggagcggcacccgguacugggccccggacgcccggaccaccacguacaacgccgggcgcuucuccacgccccagcccagcggcgcccugcccggccggaccaacccgcgcgcgaccgugcccgcccgggggucccccagcacccccuccaacaccagcaccgucaccuccguguacagcgaccagacgguguccacccgccugggcagcaccgccggguccggcacccgggucagcagccucccguccacggcccgcacccggagcuggguggaggaccagaaccgcaaccugucccccuucaugcggggcgcccacaacaucagcuucgugaccccgcccgcgucccgcagcuccagccaggggaccgucuccacggugcccaaggaggugcuggacagcuggaccggcgccuucaacacccggcgccagccccucuucgcccacauccggaagcgcggggagucccgggccuga

SEQ ID NO: 10395 - RNA, 1647 nt, Artificial Sequence
  derived and/or modified sequence opt1 from capsid_protein__Norovirus__ABS12173
augaagauggccagcaacgacgccacccccuccaacgacggcgcggccgggcuggugccggagaucaacaacgaggccauggcccucgaccccgucgccggcgcggccaucgccgcgccccugaccgggcagcagaacaucaucgaccccuggaucaugaacaacuucgugcaggccccgggcggggaguucacggugagcccccgcaacucccccggcgagguccugcucaaccuggagcugggccccgagaucaacccguaccucgcccaccuggcccggauguacaacggguacgccggcggguucgagguccaggugguccuggccggcaacgcguucaccgccgggaagaucaucuucgccgccaucccgcccaacuuccccaucgacaaccucagcgccgcgcagaucaccaugugcccccacgugaucguggacguccgccagcuggagcccgugaaccugcccaugcccgacgugcggaacaacuucuuccacuacaaccagggcuccgacagccgccuccggcugaucgccaugcuguacaccccgcuccgcgccaacaacuccggcgacgacgucuucacggugagcugccgggugcugacccgccccucccccgacuucagcuucaacuuccuggugcccccgaccguggaguccaagaccaagcccuucacgcuccccauccugaccaucagcgagauguccaacagccgguuccccgugccgaucgacucccugcacaccagccccaccgagaacaucgucgugcagugccagaacgggcgcgugacgcucgacggcgagcugauggggaccacccagcugcuccccucccagaucugcgccuuccggggcguccugacccgcagcacgucccggcccagcgaccaggccgacaccgcgaccccgcgccuguucaacuacuacuggcacauccagcucgacaaccugaacggcacccccuacgaccccgccgaggacaucccggggccccugggcacgcccgacuuccgggggaagguguucggcguggccagccagcgcaaccccgacuccaccacccgggcccacgaggccaaggucgacaccacggcggggcgcuucaccccgaagcucggcagccuggagaucuccaccgagagcggcgacuucgaccagaaccagcccacccgguucacgcccguggggaucggcgucgaccacgaggccgacuuccagcaguggucccugcccgacuacagcgggcaguucacccacaacaugaaccucgccccggccguggcgcccaacuuccccggcgagcagcugcuguucuuccgcucccagcuccccagcuccgggggccggagcaacggcauccuggacugccuggugccgcaggaguggguccagcacuucuaccaggaguccgcccccgcccagacccagguggcccucgugcgcuacgucaaccccgacaccgggcgcgugcuguucgaggccaagcugcacaagcucggcuucaugacgaucgcgaagaacggggacagccccaucaccgugccgcccaacggcuacuuccgguucgaguccugggucaaccccuucuacacccuggcccccauggggaccggcaacggccgccggcgcauccaguga

SEQ ID NO: 10396 - RNA, 1611 nt, Artificial Sequence
  derived and/or modified sequence opt1 from capsid_protein__Norovirus__ABS12175
augaagauggccagcaacgacgccacccccuccgacgacggcgcggccgggcuggugccggagaucaacagcgaggucauggcccucgagcccguggccggcgccucccuggcggcccccguggucgggcagcagaacaucaucgaccccuggauccgcaacaacuucgugcaggccccggccggcgaguucaccgugagcccccggaacucccccggggagcugcuccuggaccuggagcucggccccgagcugaacccguaccuggcgcaccucgcccgcauguacaacggccacgccgggggcauggagguccagaucgugcuggccgggaacgccuucacggcgggcaagauccuguucgccgccaucccgcccagcuuccccuacgagaaccucucccccgcccagcugaccaugugcccccacgugaucgucgacgugcggcagcuggagcccgugcuccugcccaugccggacauccgcaacgucuucuaccacuacaaccagaacaacagccccaagcugcggcucguggccaugcuguacacgccccugcgcgcgaacaacuccggggacgacguguucaccgucagcugccgggugcucacccgccccuccccggacuuccaguucaccuuccuggugccgcccaccgucgagagcaagaccaagaacuucacgcugcccgugcuccggguguccgagaugaccaacagccgcuuccccgucgugcuggaccagauguacaccucccggaacgagaacaucaucgugcagccccagaacggccgcugcaccacggacggcgagcugcucgggaccaccauccugcagagcgucuccaucugcaacuucaagggcaccaugcaggccaagcugaacgaggagccccgguaccagcuccagcugacgaaccuggacgggagccccaucgacccgaccgacgacaugcccgcgccccucggcaccccggacuuccaggccaugcuguacggcguggccucccagcgcagcagccgggacaacgccacccgcgcccacgacgcccagaucgacacggccggggacaccuucgcccccaagaucggccagguccgguucaaguccagcuccaacgacuucgaccugcacgaccccaccaaguucacccccaucggggugaacguggacgaccagcacccguuccgccagugguuccuccccaacuacggcgggcaccuggcgcugaacaaccaccucgcccccgccgucacgccccuguucccgggcgagcagauccuguucuuccggagcuacauccccuccgccggcgggcacaccgacggcgcgauggacugccuccugccccaggaguggguggagcacuucuaccaggaggccgcccccagccaguccgacaucgcccuggugcgcuucaucaacccggacaccgggcggguccucuucgaggccaagcugcacaagcagggcuuccugaccaucgcggccagcggggaccaccccaucgugaugcccacgaacggcuacuuccgcuucgaggccugggugaaccccuucuacacccucgccccggucggcaccggguccggccgccggcgcauccaguga

SEQ ID NO: 10397 - RNA, 1626 nt, Artificial Sequence
  derived and/or modified sequence opt1 from capsid_protein__Norovirus__ABS29273
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugauccagccccgccucugcacccacgcccgguggcccgccccgaucuacggccugcuggucgaccccagccuccccuccaacccccaguggcagaacgggcgcgugcacguggacggcacccugcugggcaccaccccgaucagcggguccugggucagcugcuucgcggccgaggccgccuacgaguuccaguccggcaucggggagguggccaccuucacgcucaucgagcaggacggcagcgcguacguccccggggaccgggccgcgccccugggcuacccggacuucuccggccagcuggagaucgaggugcagaccgagaccaccaagacgggggacaagcucaaggugaccaccuucgagaugauccugggccccaccacgaacgccgaccaggcccccuaccaggggcgcgucuucgccagcgugaccgccgccgccagccuggaccucguggacggccggguccgcgcggugccccgguccguguacagcuucugcgacaccaucccggaguacaacgacgggcugcuggucccccucgccccgcccaucggccccuuccugcccggcgaggugcugcuccgcuuccggaccuacaugcgccagcuggacacggccgacgccgccgcggaggccaucgacugcgcccugccccaggaguucguguccugguucgccagcaacgccuucaccguccaguccgaggcgcuccugcugcgguaccgcaacacccucaccgggcagcugcuguucgagugcaagcuguacagcgagggcuacaucgcccucuccuacagcggguccggcccccugacguucccgaccgacggguucuucgagguggugagcugggucccccgccuguaccagcucgccuccgugggcagccuggccaccggccggacccugaagcaguga

SEQ ID NO: 10398 - RNA, 1626 nt, Artificial Sequence
  derived and/or modified sequence opt1 from capsid_protein__Norovirus__ABS29275
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugauccagccccgccucugcacccacgcccgguggcccgccccggucuacggccugcugguggaccccagccuccccuccaacccccaguggcagaacgggcgcgugcacgucgacggcacccugcugggcaccaccccgaucagcggguccugggugagcugcuucgcggccgaggccgccuacgaguuccaguccggcaucggggaggucgccaccuucacgcucaucgagcaggacggcagcgcguacauccccggggaccgggccgcgccccugggcuacccggacuucuccggccagcuggagaucgaggugcagaccgagaccaccaagacgggggacaagcucaaggugaccaccuucgagaugguccugggccccaccacgaacguggaccaggcccccuaccaggggcgcguguacgccagcgucaccgccgccgccagccuggaccucguggacggccgggugcgcgccgucccccgguccaucuacagcuuccaggacaccaucccggaguacaacgacgggcugcuggugccccucgcgccgcccaucggccccuuccugcccggcgaggugcugcuccgcuuccggaccuacaugcgccagcuggacacggccgacgccgccgccgaggcgaucgacugcgcccugccccaggaguucgucuccugguucgccagcaacgccuucaccgugcaguccgaggcccuccugcugcgguaccgcaacacccucaccgggcagcugcuguucgagugcaagcuguacagcgagggcuacaucgcgcucuccuacagcggguccggcccccugacguucccgaccgacggguucuucgagguggucagcugggugccccgccuguaccagcucgccuccgugggcagccuggccaccggccggacccugaagcaguga

SEQ ID NO: 10399 - RNA, 1626 nt, Artificial Sequence
  derived and/or modified sequence opt1 from capsid_protein__Norovirus__ABU55541
augcgcaugagcgacggcgccgcccccaaggcgaacggguccgaggccagcggccaggaccuggugccggccgccgucgagcaggccgugcccauccagcccguggcgggggccgcccucgccgcgcccgccgccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgcgauguacaccggcuggguggggaacauggaggugcagcugguccucgccggcaacgccuucacggccgggaaggugguggucgcccuggugccgcccuacuuccccaagggcagccugaccaccgcgcagaucacgugcuucccccacgugaugugcgacguccgcacccucgagcccauccagcugccccugcucgacgugcggcgcgugcuguggcacgccacccaggaccaggaggaguccaugcggcuggucugcaugcucuacaccccgcugcgcaccaacagccccggcgacgaguccuucguggugagcgggcggcugcucuccaagcccgccgccgacuucaacuucgucuaccugacgcccccgaucgagcgcaccaucuaccggaugguggaccugcccgugauccagccccgccucugcacccacgcccgguggcccgcgccggucuacggccugcugguggaccccagccuccccuccaacccccaguggcagaacgggcgcgugcacgucgacggcacccugcugggcacgaccccgaucagcggguccugggugagcugcuucgccgccgaggccgccuacaaguuccaguccggcaccggggaggucgcgaccuucacgcucaucgagcaggacggcagcgccuacgugcccggggaccgggccgcgccccugggcuacccggacuucuccggccagcuggagaucgaggugcagaccgagaccaccaagacgggggacaagcucaaggucaccaccuucgagaugauccugggccccaccacgaacgccgaccaggcccccuaccaggggcgcguguucgccagcgugaccgccgccgcgagccuggaccucgucgacggccgggugcgcgccgugccccgguccaucuacggguuccaggacaccaucccggaguacaacgacggccugcuggucccccucgccccgcccaucggccccuuccugcccggggaggugcugcuccgcuuccggaccuacaugcgccagaucgacacggccgacgccgcggccgaggccaucgacugcgcccugccccaggaguucgugagcugguucgccuccaacgcguucaccguccagagcgaggcccugcuccugcgguaccgcaacacccugaccggccagcuccuguucgagugcaagcuguacaacgagggguacaucgcccuguccuacagcggcuccgggccccucacguucccgaccgacggcaucuucgagguggugagcugggucccccgccuguaccagcuggccuccgugggcagccucgcgaccgggcggaugcugaagcaguga

SEQ ID NO: 10400 - RNA, 1626 nt, Artificial Sequence; identical to SEQ ID NO: 10399
  derived and/or modified sequence opt1 from capsid_protein__Norovirus__ABU55544

SEQ ID NO: 10401 - RNA, 1626 nt, Artificial Sequence
  derived and/or modified sequence opt1 from capsid_protein__Norovirus__ABU55547
augcgcaugagcgacggcgccgcccccaaggcgaacggguccgaggccagcggccaggaccuggugccggccgccgucgagcaggccgugcccauccagcccguggcgggggccgcccucgccgcgcccgccgccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgcgauguacaccggcuggguggggaacauggaggugcagcugguccucgccggcaacgccuucacggccgggaaggugguggucgcccuggugccgcccuacuuccccaagggcagccugaccaccgcgcagaucacgugcuucccccacgugaugugcgacguccgcacccucgagcccauccagcugccccugcucgacgugcggcgcgugcuguggcacgccacccaggaccaggaggaguccaugcggcuggucugcaugcucuacaccccgcugcgcaccaacagccccggcgacgaguccuucguggugagcgggcggcugcucuccaagcccgccgccgacuucaacuucgucuaccugacgcccccgaucgagcgcaccaucuaccggaugguggaccugcccgugauccagccccgccucugcacccacgcccgguggcccgcgccggucuacggccugcugguggaccccagccuccccuccaacccccaguggcagaacgggcgcgugcacgucgacggcacccugcugggcacgaccccgaucagcggguccugggugagcugcuucgccgccgaggccgccuacaaguuccaguccggcaccggggaggucgcgaccuucacgcucaucgagcaggacggcagcgccuacgugcccggggaccgggccgcgccccugggcuacccggacuucuccggccagcuggagaucgaggugcagaccgagaccaccaagacgggggacaagcucaaggucaccaccuucgagaugauccugggccccaccacgaacgccgaccaggcccccuaccaggggcgcguguucgccagcgugaccgccgccgcgagccuggaccucgucgacucccgggugcgcgccgugccccggagcaucuacggcuuccaggacaccaucccggaguacaacgacgggcugcuggucccccucgccccgcccaucggccccuuccugcccggcgaggugcugcuccgcuuccggaccuacaugcgccagaucgacacggccgacgccgcggccgaggccaucgacugcgcccugccccaggaguucguguccugguucgccagcaacgcguucaccguccaguccgaggcccugcuccugcgguaccgcaacacccugaccgggcagcuccuguucgagugcaagcuguacaacgagggcuacaucgcccugagcuacuccgggagcggcccccucacguucccgaccgacgggaucuucgaggugguguccugggucccccgccuguaccagcuggccagcgugggcucccucgcgaccggccggaugcugaagcaguga

SEQ ID NO: 10402 - RNA, 1626 nt, Artificial Sequence; identical to SEQ ID NO: 10399
  derived and/or modified sequence opt1 from capsid_protein__Norovirus__ABU55550

SEQ ID NO: 10403 - RNA, 1626 nt, Artificial Sequence; identical to SEQ ID NO: 10399
  derived and/or modified sequence opt1 from capsid_protein__Norovirus__ABU55553

SEQ ID NO: 10404 - RNA, 1626 nt, Artificial Sequence
  derived and/or modified sequence opt1 from capsid_protein__Norovirus__ABU55556
augcgcaugagcgacggcgccgcccccaaggcgaacggguccgacgccagcggccaggaccuggugccggccgccgucgagcaggccgugcccauccagcccguggcgggggccgcccucgccgcgcccgccgccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgcgauguacaccggcuggguggggaacauggaggugcagcugguccucgccggcaacgccuucacggccgggaaggugguggucgcccuggugccgcccuacuuccccaagggcagccugaccaccgcgcagaucacgugcuucccccacgugaugugcgacguccgcacccucgagcccauccagcugccccugcucgacgugcggcgcgugcuguggcacgccacccaggaccaggaggaguccaugcggcuggucugcaugcucuacaccccgcugcgcaccaacagccccggcgacgaguccuucguggugagcgggcggcugcucuccaagcccgccgccgacuucaacuucgucuaccugacgcccccgaucgagcgcaccaucuaccggaugguggaccugcccgugauccagccccgccucugcacccacgcccgguggcccgcgccggucuacggccugcugguggaccccagccuccccuccaacccccaguggcagaacgggcgcgugcacgucgacggcacccugcugggcacgaccccgaucagcggguccugggugagcugcuucgccgccgaggccgccuacaaguuccaguccggcaccggggaggucgcgaccuucacgcucaucgagcaggacggcagcgccuacgugcccggggaccgggccgcgccccugggcuacccggacuucuccggccagcuggagaucgaggugcagaccgagaccaccaagacgggggacaagcucaaggucaccaccuucgagaugauccugggccccaccacgaacgccgaccaggcccccuaccaggggcgcguguucgccagcgugaccgccgccgcgagccuggaccucgucgacggccgggugcgcgccgugccccgguccaucuacggguuccaggacaccaucccggaguacaacgacggccugcuggucccccucgccccgcccaucggccccuuccugcccggggaggugcugcuccgcuuccggaccuacaugcgccagaucgacacggccgacgccgcggccgaggccaucgacugcgcccugccccaggaguucgugagcugguucgccuccaacgcguucaccguccagagcgaggcccugcuccugcgguaccgcaacacccugaccggccagcuccuguucgagugcaagcuguacaacgagggguacaucgcccuguccuacagcggcuccgggccccucacguucccgaccgacggcaucuucgagguggugagcugggucccccgccuguaccagcuggccuccgugggcagccucgcgaccgggcggaugcugaagcaguga

SEQ ID NO: 10405 - RNA, 1626 nt, Artificial Sequence
  derived and/or modified sequence opt1 from capsid_protein__Norovirus__ABU55559
augcgcaugagcgacggcgccgcccccaaggcgaacggguccgaggccagcggccaggaccuggugccggccgccgucgagcaggccgugcccauccagcccguggcgggggccgcccucgccgcgcccgccgccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgcgauguacaccggcuggguggggaacauggaggugcagcugguccucgccggcaacgccuucacggccgggaaggugguggucgcccuggugccgcccuacuuccccaagggcagccugaccaccgcgcagaucacgugcuucccccacgugaugugcgacguccgcacccucgagcccauccagcugccccugcucgacgugcggcgcgugcuguggcacgccacccaggaccaggaggaguccaugcggcuggucugcaugcucuacaccccgcugcgcaccaacagccccggcgacgaguccuucguggugagcgggcggcugcucuccaagcccgccgccgacuucaacuucgucuaccugacgcccccgaucgagcgcaccaucuaccggaugguggaccugcccgugauccagccccgccucugcacccacgcccgguggcccgcgccggucuacggccugcugguggaccccagccuccccuccaacccccaguggcagaacgggcgcgugcacgucgacggcacccugcugggcacgaccccgaucagcggguccugggugagcugcuucgccgccgaggccgccuacgaguuccaguccggcaccggggaggucgcgaccuucacgcucaucgagcaggacggcagcgccuacgugcccggggaccgggccgcgccccugggcuacccggacuucuccggccagcuggagaucgaggugcagaccgagaccaccaagacgggggacaagcucaaggucaccaccuucgagaugauccugggccccaccacgaacgccgaccaggcccccuaccaggggcgcguguucgccagcgugaccgccgccgcgagccuggaccucgucgacggccgggugcgcgccgugccccgguccaucuacggguuccaggacaccaucccggaguacaacgacggccugcuggucccccucgccccgcccaucggccccuuccugcccggggaggugcugcuccgcuuccggaccuacaugcgccagaucgacacggccgacgccgcggccgaggccaucgacugcgcccugccccaggaguucgugagcugguucgccuccaacgcguucaccguccagagcgaggcccugcuccugcgguaccgcaacacccugaccggccagcuccuguucgagugcaagcuguacaacgagggguacaucgcccuguccuacagcggcuccgggccccucacguucccgaccgacggcaucuucgagguggugagcugggucccccgccuguaccagcuggccuccgugggcagccucgcgaccgggcggaugcugaagcaguga

SEQ ID NO: 10406 - RNA, 1626 nt, Artificial Sequence; identical to SEQ ID NO: 10399
  derived and/or modified sequence opt1 from capsid_protein__Norovirus__ABU55562

SEQ ID NO: 10407 - RNA, 1626 nt, Artificial Sequence; identical to SEQ ID NO: 10399
  derived and/or modified sequence opt1 from capsid_protein__Norovirus__ABU55565

SEQ ID NO: 10408 - RNA, 1626 nt, Artificial Sequence
  derived and/or modified sequence opt1 from capsid_protein__Norovirus__ABU55568
augcgcaugagcgacggcgccgcccccaaggcgaacggguccgaggccagcggccaggacuucgugccggccgccgucgagcaggccgugcccauccagcccguggcgggggccgcccuggccgcgcccgccgccggccagaucaaccagaucgacccguggaucuuccagaacuucguccagugcccccucggggaguucuccaucagcccccggaacacccccggcgagauccuguucgaccuggcccucggcccggggcugaaccccuaccuggcccaccucuccgcgauguacaccggcuggguggggaacauggaggugcagcugguccuggccggcaacgccuucacggccgggaaggugguggucgcccucgugccgcccuacuuccccaagggcagccugaccaccgcgcagaucacgugcuucccccacgugaugugcgacguccgcacccuggagcccauccagcucccccugcuggacgugcggcgcgugcucuggcacgccacccaggaccaggaggaguccaugcggcuggucugcaugcuguacaccccgcuccgcaccaacagccccggcgacgaguccuucguggugagcgggcggcugcuguccaagcccgccgccgacuucaacuucgucuaccucacgcccccgaucgagcgcaccguguaccggaugguggaccugcccguccugcagccccgccucugcacccacgcccgguggcccgcgccgguguacggccugcugaucgaccccagccuccccuccaacccccaguggcagaacgggcgcgugcacgucaacggcacccugcugggcacgaccccggugagcggguccugggucagcugcuucgccgccgaggccgccuacgaguuccaguccggcaucggggagguggcgaccuucaccaugaucgagcaggacggcagcgccuacgugcccggggaccgggccgcgccccucggcuacccggacuucuccggccagcuggagaucgagguccagacggagaccaccaagagcggggacaagcugaaggugaccacguucgagaugauccucggccccaccaccaacgccgaccagacccccuaccaggggaagguguacgccagcaucgccgccgccgcgucccuggaccuggucgacggccgcgugcgggccgugccccgcagcgucuacgccuuccaggacgugcucccggaguacaacgacgggcugcuggugccccucgccccgccccugggccccuuccugcccggcgagguccuccugcgguuccgcacguacgugcggcagcuggacaccgccgacgcggccgcccagcccaucgacugcgcccucccccaggaguucaucuccugguucgccagcaacaacuucaccgugcaguccgacgcgcugcugauccgcuaccggaacacccucacggggcagcugcuguucgaggccaagcuguacagcgagggcuacaucgccgucuccuacagcggguccggcccgcucaccuuccccaccgacggguucuucgagguggugagcugggucccccgccuguuccagcuggccuccgugggcagccucgcgaccggccgcacgcugaagcaguga

SEQ ID NO: 10409 - RNA, 1626 nt, Artificial Sequence
  derived and/or modified sequence opt1 from capsid_protein__Norovirus__ABU55571
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccguguaccggaugguggaccugcccguccuccagccccgccugugcacccacgcccgguggcccgccccgaucuacggccugcucaucgaccccagccugcccuccaacccccaguggcagaacgggcgcgugcacgugaacggcacccugcucggcaccaccccggucagcggguccugggugagcugcuucgcggccgaggccgccuacgaguuccaguccggcaccggggaggucgccacguucaccaugaucgagcaggacggcagcgcguacgugcccggggaccgggccgcgccccugggcuacccggacuucuccggccagcuggagaucgaggugcagaccgagaccacgaagaccggggacaagcucaaggucaccaccuucgagauggugcugggccccacgaccaacguggaccaggcccccuaccaggggcgcaccuacgccagccugaccgccgccgccagccucgaccuggucgacggccgggugcgcgccgugccccgguccaucuacagcuuccaggacguccugccggaguacaacgacgggcuccuggugccccuggcgccgccccucggccccuuccugcccggcgaggugcugcuccgcuuccggacguacaugcgccagcuggacaccgccgacgccgccgcccagcccaucgacugcgcgcugccccaggaguucaucuccugguucgccagcaacaacuucaccguccaguccgacgcccuccugauccgguaccgcaacacccugacggggcagcuccuguucgaggccaagcuguacagcgagggcuacaucgccguguccuacagcggguccggcccgcugaccuuccccaccgacggguucuucgagguggucagcugggugccccgccucuuccagcuggcguccgugggcagccuggccaccggccggacgcucaagcaguga

SEQ ID NO: 10410 - RNA, 1626 nt, Artificial Sequence
  derived and/or modified sequence opt1 from capsid_protein__Norovirus__ABU55577
augcgcaugagcgacggcgccgcccccaaggcgaacggguccgaggccaucggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcucccugaccaccgcccagaucacgugcuucccccacgugaugugcgacguccgcgcgcucgagcccauccagcugccccugcucgacgugcggcgcgugcuguggcacgccacccaggaccaggaggagagcaugcggcuggucugcaugcucuacaccccgcugcgcaccaacucccccggcgacgagagcuucgugguguccgggcggcugcucagcaagcccgccgccgacuucaacuucgucuaccugacgcccccgaucgagcgcaccguguaccggaugguggaccugcccguccuccagccccgccugugcacccacgcccgguggcccgcgccgguguacggccugcucguggaccccucccugcccagcaacccccaguggcagaacgggcgcguccacgugaacggcacccugcucggcacgaccccggucuccgggagcuggguguccugcuucgccgccgaggccgccuacgaguuccagagcggcaccggggagguggcgaccuucacgaugaucgagcaggacggcuccgccuacguccccggggaccgggccgcgccccugggcuacccggacuucagcggccagcuggagaucgaggugcagaccgagaccaccaaguccggggacaagcucaaggugacgaccuucgagaugauccugggccccaccaccaacgccgaccagacgcccuaccaggggcgcgucuacgccagcaucgccgccgccgcgccccuggaccucguggacggccgggugcgcgccgucccgcggagcguguacuucuuccaggacgugcugcccgaguacaacgacgggcugcucgucccccuggcgcccccgcugggccccuuccuccccggcgaggugcugcugcgcuuccggaccuacgugcgccagcucgacaccgccgacgccgccgcccagcccaucgacugcgcccugccgcaggaguucaucuccugguucgccagcaacuccuucaccguccagagcgaggcccugcucauccgguaccgcaacacgcugaccgggcagcugcuguucgaggcgaagcucuacuccgagggcuacaucgccgugagcuacuccgggagcggcccccugaccuuccccaccgacggguucuucgagguggucuccugggugccccgccuguuccagcucgccagcgugggcucccuggccacgggccggacccugaagcaguga

SEQ ID NO: 10411 - RNA, 1626 nt, Artificial Sequence
  derived and/or modified sequence opt1 from capsid_protein__Norovirus__ABU55580
augcgcaugagcgacggcgccgcccccaaggcgaacggguccgaggccaucggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcucccugaccaccgcccagaucacgugcuucccccacgugaugugcgacguccgcgcgcucgagcccauccagcugccccugcucgacgugcggcgcgugcuguggcacgccacccaggaccaggaggagagcaugcggcuggucugcaugcucuacaccccgcugcgcaccaacucccccggcgacgagagcuucgugguguccgggcggcugcucagcaagcccgccgccgacuucaacuucgucuaccugacgcccccgaucgagcgcaccguguaccggaugguggaccugcccguccuccagccccgccugugcacccacgcccgguggcccgcgccgguguacggccugcucguggaccccucccugcccagcaacccccaguggcagaacgggcgcguccacgugaacggcacccugcucggcacgaccccggucuccgggagcuggguguccugcuucgccgccgaggccgccuacgaguuccagagcggcaccggggagguggcgaccuucacgaugaucgagcaggacggcuccgccuacguccccggggaccgggccgcgccccugggcuacccggacuucagcggccagcuggagaucgaggugcagaccgagaccaccaaguccggggacaagcucaaggugacgaccuucgagaugauccugggccccaccaccaacgccgaccaggcccccuaccaggggcgcgucuacgccagccuggccgccgcggcgccccucgaccugguggacggccgggugcgcgccgucccgcggagcguguacuucuuccaggacgugcugcccgaguacaacgacgggcuccuggucccccuggcgcccccgcucggccccuuccugcccggcgaggugcugcuccgcuuccggacguacgugcgccagcuggacaccgccgacgccgccgcccagcccaucgacugcgcccugccgcaggaguucaucuccugguucgccagcaacuccuucaccguccagagcgaggcccuccugauccgguaccgcaacacccugacggggcagcuccuguucgaggccaagcuguacuccgagggcuacaucgccgugagcuacuccgggagcggcccccugaccuuccccaccgacggguucuucgagguggucuccugggugccccgccucuuccagcuggccagcgugggcucccuggcgaccggccggacgcucaagcaguga

SEQ ID NO: 10412 - RNA, 1626 nt, Artificial Sequence
  derived and/or modified sequence opt1 from capsid_protein__Norovirus__ABU55586
augcgcaugagcgacggcgccgcccccaaggcgaacggguccgaggccaucggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcucccugaccaccgcccagaucacgugcuucccccacgugaugugcgacguccgcgcgcucgagcccauccagcugccccugcucgacgugcggcgcgugcuguggcacgccacccaggaccaggaggagagcaugcggcuggucugcaugcucuacaccccgcugcgcaccaacucccccggcgacgagagcuucgugguguccgggcggcugcucagcaagcccgccgccgacuucaacuucgucuaccugacgcccccgaucgagcgcaccguguaccggaugguggaccugcccguccuccagccccgccugugcacccacgcccgguggcccgcgccgguguacggccugcucguggaccccucccugcccagcaacccccaguggcagaacgggcgcguccacgugaacggcacccugcucggcacgaccccggucuccgggagcuggguguccugcuucgccgccgaggccgccuacgaguuccagagcggcaccggggagguggcgaccuucacgaugaucgagcaggacggcuccgccuacguccccggggaccgggccgcgccccugggcuacccggacuucagcggccagcuggagaucgaggugcagaccgagaccaccaaguccggggacaagcucaaggugacgaccuucgagaugauccugggccccaccaccaacgccgaccaggcccccuaccaggggaaggucuacgccagccuggccgccgcggcgccccucgaccugguggacggccgcgugcgggccgucccgcgcagcguguacuucuuccaggacgugcugcccgaguacaacgacgggcuccuggucccccuggcgcccccgcucggccccuuccugcccggcgaggugcugcuccgguuccgcacguacgugcggcagcuggacaccgccgacgccgccgcccagcccaucgacugcgcccugccgcaggaguucaucuccugguucgccagcaacuccuucaccguccagagcgacgcccuccugauccgcuaccggaacacccugacggggcagcuccuguucgaggccaagcuguacuccgagggcuacaucgccgugagcuacuccgggagcggcccccugaccuuccccaccgacggguucuucgagguggucuccugggugccccgccucuuccagcuggccagcgugggcucccuggcgaccggccgcacgcucaagcaguga

SEQ ID NO: 10413 - RNA, 1626 nt, Artificial Sequence
  derived and/or modified sequence opt1 from capsid_protein__Norovirus__ABU55589
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccguguaccggaugguggaccugcccguccuccagccccgccugugcacccacgcccgguggcccgccccgguguacggccugcucaucgaccccagccugcccuccaacccccaguggcagaacgggcgcgugcacgucaacggcacgcugcucggcaccaccccggugagcggguccugggucagcugcuucgcggccgaggccgccuacgaguuccaguccggcaccggggagguggccacguucaccaugaucgagcaggacggcagcgcguacgugcccggggaccgggccgcgccccugggcuacccggacuucuccggccagcuggagaucgagguccagaccgagaccaccaagagcggggacaagcuccgcgugaccaccuucgagaugauccugggccccaccacgaacguggaccaggcccccuaccaggggcgggucuacgccagccuggccgccgccgccucccucgaccugguggacggccgcgugcgggcggucccccgcagcguguacuccuuccaggacgugcugccggaguacaacgacgggcuccuggucccccuggccccgccccucggccccuuccugcccggcgaggugcugcuccgguuccgcaccuacaugcggcagcuggacaccgccgacgccgccgcgcagcccaucgacugcgcccugccccaggaguucaucagcugguucgccuccaacaacuucaccgugcagagcgacgcccuccugauccgcuaccgcaacacgcugaccgggcagcuccuguucgaggccaagcuguacuccgagggcuacaucgcggucagcuacuccgggagcggcccgcugaccuuccccaccgacggguucuucgaggugguguccugggucccccgccucuuccagcuggccagcgugggcucccuggccacgggccggacccucaagcaguga

SEQ ID NO: 10414 - RNA, 1626 nt, Artificial Sequence
  derived and/or modified sequence opt1 from capsid_protein__Norovirus__ABU55598
augcgcaugagcgacggcgccgcccccaaggcguccgggagcgaggccuccggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcucccugaccaccgcccagaucacgugcuucccccacgugaugugcgacguccgcacccucgagcccauccagcugccccugcucgacgugcggcgcgugcuguggcacgcgacccaggaccaggaggagagcaugcggcuggucugcaugcucuacaccccgcugcgcacgaacucccccggcgacgagagcuucgugguguccgggcggcugcucagcaagcccgccgccgacuucaacuucgucuaccugacgcccccgaucgagcgcaccaucuaccggaugguggaccugcccgugcuccagccccgccugugcacccacgcccgguggcccgccccggucuacggccugcucguggaccccucccugcccagcaacccccaguggcagaacgggcgcgugcacaucgacggcacccugcucggcaccaccccggucuccgggagcuggguguccugcuucgcggccgaggccgccuacgaguuccagagcggcaccggggaggucgccacguucacccugaucgagcaggacggcuccgcguacgugcccggggaccgggccgcgccccugggcuacccggacuucagcggccagcucgagaucgaggugcagaccgagaccacgcgcgccggggacaagcugaaggucaccaccuucgagaugauccugggccccaccacgaacguggaccaggcccccuaccaggggcggguguacgccagccucaccgccgccgccucccuggaccuggucgacggccgcgugcgggcggugccccgcagcaucuacuccuuccaggacguccucccggaguacaacgacgggcugcuggugccccucgccccgcccaucggccccuuccugcccggcgaggugcugcuccgguuccgcaccuacaugcggcaggucgacagcuccgacgccgccgccgaggcgaucgacugcgcccugccccaggaguucgugagcugguucgccuccaacggguucaccgugcagagcgaggcccugcuccugcgcuaccgcaacacgcugaccggccagcuccuguucgagugcaagcuguacuccgagggguacaucgcccugagcuacuccggcagcgggccccucaccuucccgaccgacggcuucuucgaggucguguccugggugccccggcuguuccagcuggcgagcgucggcucccucgugacggggcgcacccugaagcaguga

SEQ ID NO: 10415 - RNA, 1626 nt, Artificial Sequence
  derived and/or modified sequence opt1 from capsid_protein__Norovirus__ABU55601
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggauggccgaccugcccgugcuccagccccgccugugcacccacgcccgguggcccgcgccgguguacggccugcucgucgaccccagccugcccuccaacccccaguggcagaacgggcgcgugcacguggacggcacccugcucggcaccaccccgaucagcggguccugggucagcugcuucgccgccgaggccgccuacgaguuccaguccggcaccggggagguggcgacgcugacccugaucgagcaggacggcagcgccuacguccccggggaccgggccgcgccccucggcuacccggacuucuccggccagcuggagaucgaggugcagaccgagaccacgaaggccggggacaagcugaaggugaccaccuucgacaugauccucggccccaccacgaacgucgaccaggcccccuaccaggggcgcguguacgccagcgugagcaccgccgccucccugggccuggucgacgggcgggugcgcgcggugccccggagcaucuacggcuuccaggacaccaucccggaguacaacgacggccuccuggucccccuggccccgcccaucgggcccuuccuccccggcgaggugcugcugcgcuuccggaccuacaugcgccagaucgacacggccgacgccgccgcggaggccaucgacugcgcccucccccaggaguucaucuccugguucgccagcaacgccuucaccgugcaguccgaggcgcugcugcuccgguaccgcaacacccugaccgggcagcugcuguucgagugcaagcucuacagcgagggcuacaucgcccuguccuacagcggguccggcccccugacguucccgaccgacggcuucuucgaggccgucagcugggugccccgccucuaccagcuggccuccguggggagccuggcgaccggccggacccucaagcaguga

SEQ ID NO: 10416 - RNA, 1626 nt, Artificial Sequence
  derived and/or modified sequence opt1 from capsid_protein__Norovirus__ABU55604
augcgcaugagcgacggcgccgcgccccgggccaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccgcaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccggacccucgagcccauccagcugccccugcucgacgugcgccgggugcuguggcacgcgacccaggaccaggaggaguccaugcgccuggucugcaugcucuacaccccgcugcggacgaacagccccggcgacgaguccuucguggugagcgggcgccugcucuccaagcccgccgccgacuucaacuucgucuaccugacgcccccgaucgagcggaccaucuaccgcaugguggaccugcccgugauccagccccggcucugcacccacgcccgcuggcccgccccgaucuacggccugcuggucgaccccagccuccccuccaacccccaguggcagaacgggcgggugcacguggacggcacccugcugggcaccaccccgaucagcggguccugggucagcugcuucgcggccgaggccgccuacgaguuccaguccggcaccggggagguggccacguucacccucaucgagcaggacggcagcgcguacguccccggggaccgcgccgcgccccugggcuacccggacuucuccggccagcuggagaucgaggugcagaccgagaccacgaagaccggggacaagcucaaggugaccaccuucgagaugauccugggccccacgaccaacgucgaccaggcccccuaccaggggcggguguacgccagcguggccgccgccgccagccuggaccucgucgacggccgcgugcgggcggugccccgcuccaucuacggguuccaggacgucaucccggaguacaacgacggccugcuggugccccucgccccgcccaucggccccuuccugcccggggaggugcugcuccgguuccgcaccuacaugcggcagcuggacaccgccgacgccgccgcggaggccaucgacugcgcccugccccaggaguucgucagcugguucgccuccaacgccuucacggugcagagcgaggcgcuccugcugcgcuaccgcaacacccucaccggccagcugcuguucgagugcaagcuguacuccgagggguacaucgcccucagcuacuccggcagcgggccccugaccuucccggccgacggcuucuucgagguggucuccugggugccccggcuguaccagcucgccagcgugggcucccuggcgacggggcgcaugcugcggcaguga

SEQ ID NO: 10417 - RNA, 1626 nt, Artificial Sequence
  derived and/or modified sequence opt1 from capsid_protein__Norovirus__ABU55607
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgcccccgacuucaacuucgucuaccugaccccgcccaucgagcgcaccaucuaccggaugguggaccugcccgugcuccagccccgccugugcacccacgcccgguggccggcccccgucuacggccugcucguggaccccagccugcccuccaacccgcaguggcagaacgggcgcgugcaggucgacggcacgcugcucggcaccacccccgugagcggguccugggucagcugcuucgccgcggaggccgccuacgaguuccaggccggcaccggggagguggugacguucaccaugaucgagcaggacggcuccgccuacguccccggggaccgggcggccccgcugggcuaccccgacuucagcggccagcuggagaucgaggugcagaccgagaccacgaagaccggggacaagcuccgcgugaccaccuucgagaugauccugggccccacgaccaacgucgaccaggcccccuaccaggggcgggccuacgcgucccugaccgccgccgccagccucgaccugguggacggccgcgugcgggccgucccgcgcagcaucuacuccuuccaggacgagcugcccgaguacaacgacgggcuccuggugccccuggcgcccccgcucggccccuuccugcccggcgaggugcugcuccgguuccgcaccuacaugcggcagcuggacacggccgacgccgccgcccagcccaucgacugcgcgcugccgcaggaguucaucagcugguucgccuccaacaacuucaccguccagagcgacgcccuccuggugcgcuaccgcaacacccugaccgggcagcuccucuucgaggccaagcuguacuccgagggcuacaucgccgugagcuacuccgggagcggcccccugacguuccccaccgacggguucuucgaggucguguccugggugccccggcuguuccagcuggcgagcgucggcucccuggugaccggccgcacccucaagcaguga

SEQ ID NO: 10418 - RNA, 1626 nt, Artificial Sequence
  derived and/or modified sequence opt1 from capsid_protein__Norovirus__ABU55610
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccgugagcccccggaacacccccggcgagauccuguucgaccucgcccugggcccggggcugaaccccuaccucgcccaccuguccgccauguacacgggcuggguggggaacauggagguccagcuggugcucgcgggcaacgccuucaccgccgggaagguggucguggcccuggugccgcccuacuuccccaagggcagccugaccaccgcccagaucacgugcuucccccacgucaugugcgacgugcgcacccucgagcccauccagcugccccugcucgacgugcggcgcguccuguggcacgcgacccaggaccaggaggaguccaugcggcuggugugcaugcucuacaccccgcugcgcacgaacagccccuccgacgagagcuucguggucuccggccggcugcucagcaagcccgccgccgacuucaacuucguguaccugacgcccccgaucgagcgcaccaucuaccggaugguggaccugcccguccuccagccccgccugugcacccacgcccgguggcccgccccgguguacgggcugcucguggaccccucccugcccagcaacccccaguggcagaacggccgcguccacguggacgggacccugcucggcaccaccccgaucuccggcagcugggucuccugcuucgcggccgaggccgccuacgaguuccagagcgggaccggcgagguggccacguucacccugguggagcaggacggguccgcguacguccccggcgaccgggccgcgccccugggguacccggacuucagcggccagcucgagaucgaggugcagaccgagaccacgaagcccggcgagaagcugaaggugaccaccuucgagaugauccuggggcccaccacgaacgucgaccaggcccccuaccgcggcaagguguucgccagcaucaccaccgccgccucccucagccugguggacgggcggguccgcgccgugccgcgguccaucuacagcuuccaggacgugauccccgaguacaacgacggccugcucgucccccuggcgcccccgaucgggcccuuccugcccggcgaggugcuccugcgcuuccggaccuacaugcgccagcuggacuccgccgacgccgccgccgaggccaucgacugcgcgcucccccaggaguucgugagcugguucgccuccaacgccuucacgguccagagcgaggcccugcugcuccgguaccgcaacacccugaccggccagcugcuguucgagugcaagcucuacuccgagggguacaucgcccugagcuacuccggcagcgggccgcugaccuuccccacggacggcuucuucgaggugguguccugggucccccgccucuaccagcuggcgagcguggggucccuggccaccggccggacccucaagcaguga

SEQ ID NO: 10419 - RNA, 1626 nt, Artificial Sequence
  derived and/or modified sequence opt1 from capsid_protein__Norovirus__ABU55613
augcgcaugagcgacggcgccgcccccaaggcgaacggguccgaggccagcggccaggaccuggugccgaccgccgucgagcaggccgugcccauccagcccguggccggguccgcgcucgccgcccccgccgcgggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgccggcaacgcguucaccgccgggaaggugguggucgcccuggugccgcccuacuuccccaagggcucccugaccaccgcccagaucacgugcuucccccacgugaugugcgacguccgcacccucgagcccauccagcugccccugcucgacgugcggcgcgugcuguggcacgccacccaggaccaggaggagagcaugcggcuggucugcaugcucuacaccccgcugcgcacgaacucccccggcgacgagagcuucgugguguccgggcggcugcucagcaagcccgcggccgacuucaacuucgucuaccugacgcccccgaucgagcgcaccaucuaccggaugguggaccugcccgugcuccagccccgccugugcacccacgcccgguggcccgccccgaucuacggccugcucgucgaccccucccugcccagcaacccccaguggcagaacgggcgcgugcacguggacggcacccugcucggcaccaccccggucuccgggagcuggguguccugcuucgccgcggaggccgccuacgaguuccagagcggcaccggggaggucgccacguucacccugaucgagcaggacggcuccgccuacgugcccggggaccgggcggcgccccugggcuacccggacuucagcggccagcucgagaucgaggugcagaccgagaccacgaagaccggggacaagcugaaggucaccaccuucgagaugauccugggccccacgaccaacguggaccaggcccccuaccaggggcgcguguacgccagccucaccgccgucgccucccuggaccugguggacggccgggugcgcgccgucccccggagcaucuacggguuccaggacgugaucccggaguacaacgacggccuccuggugccccuggccccgcccaucggccccuuccuccccggggagguccugcugcgcuuccggaccuacaugcgccagcucgacacggccgacgcggccgccgaggccaucgacugcgcccugccccaggaguucaucuccugguucgcgagcaacgccuucaccgugcaguccgacgcccugcuccugcgguaccgcaacacccugaccggccagcuccuguucgagugcaagcuguacagcgagggguacaucgcccuguccuacagcggcuccgggccccucacguucccgaccgacggcuucuucgagguggucagcugggugccccgccuguuccagcuggccuccgugggcagccucaccaccgggcggacgcugaagcaguga

SEQ ID NO: 10420 - RNA, 1626 nt, Artificial Sequence
  derived and/or modified sequence opt1 from capsid_protein__Norovirus__ABU55616
augcgcaugagcgacggcgccgcccccaaggccaacggguccgaggccagcggccaggaccuggugccgaccgccaucgagcaggccguccccauccagcccguggccggguccgcgcucgccgcccccgccgcgggccagaucaaccagaucgacccguggaucuuccagaacuucgugcagugcccccugggggaguucagcaucagcccccggaacacccccggcgagauccuguucgaccucgcccugggcccggggcugaaccccuaccucgcccaccuguccgccauguacacgggcugggucgggaacauggaggugcagcuggugcucgccggcaacgcguucaccgccgggaaggucgugguggcccuggucccgcccuacuuccccaagggcucccugaccaccgcccagaucacgugcuucccccacgugaugugcgacgugcgcacccucgagcccauccagcugccccugcucgacguccggcgcgugcuguggcacgccacccaggaccaggaggagagcaugcggcuggugugcaugcucuacaccccgcugcgcacgaacucccccggcgacgagagcuucgucguguccgggcggcugcucagcaagcccgcggccgacuucaacuucguguaccugacgcccccgaucgagcgcaccaucuaccggauggucgaccugcccgugcuccagccccgccugugcacccacgcccgguggcccgccccgaucuacggccugcucguggaccccucccugcccagcaacccccaguggcagaacgggcgcguccacguggacggcacccugcucggcaccaccccgguguccgggagcugggucuccugcuucgccgcggaggccgccuacgaguuccagagcggcaccggggagguggccacguucacccugaucgagcaggacggcuccgccuacguccccggggaccgggcggcgccccugggcuacccggacuucagcggccagcucgagaucgaggugcagaccgagaccacgaagaccggggacaagcugaaggugaccaccuucgagaugauccugggccccacgaccaacgucgaccaggcccccuaccaggggaagguguacgccagccucgccguggccgccucccuggaccuggucgacggccgcgugcgggccgugccccgcagcaucuacggguuccaggacgucaucccggaguacaacgacggccuccuggugccccuggccccgcccaucggccccuuccuccccggggagauccugcugcgguuccgcaccuacaugcggcagcucgacaccgcggacgccgccgccgaggccaucgacugcgcgcugccccaggaguucaucuccugguucgccagcaacgccuucacggugcaggccgacgcccugcuccugcgcuaccggaacacccugaccggccagcuccuguucgagugcaagcuguacuccgagggguacaucgcgcugagcuacuccggcagcgcgccccucaccuucccgacggacggguucuucgaggucguguccugggugccccgccuguuccagcuggccagcgucggcucccucaccaccggccgcacccugaagcaguga

SEQ ID NO: 10421 - RNA, 1626 nt, Artificial Sequence
  derived and/or modified sequence opt1 from capsid_protein__Norovirus__ABU55619
augcgcaugagcgacggcgccgcccccaaggcgaacggguccgaggccagcggccaggaccuggugccgaccgccgucgagcaggccgugcccauccagcccguggccggguccgcgcucgccgcccccgccgcgggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgccggcaacgcguucaccgccgggaaggugguggucgcccuggugccgcccuacuuccccaagggcucccugaccaccgcccagaucacgugcuucccccacgugaugugcgacguccgcacccucgagcccauccagcugccccugcucgacgugcggcgcgugcuguggcacgccacccaggaccaggaggagagcaugcggcuggucugcaugcucuacaccccgcugcgcacgaacucccccggcgacgagagcuucgugguguccgggcggcugcucagcaagcccgcggccgacuucaacuucgucuaccugacgcccccgaucgagcgcaccaucuaccggaugguggaccugcccgugcuccagccccgccugugcacccacgcccgguggcccgccccgaucuacggccugcucgucgaccccucccugcccagcaacccccaguggcagaacgggcgcgugcacguggacggcacccugcucggcaccaccccggucuccgggagcuggguguccugcuucgccgcggaggccgccuacgaguuccagagcggcaccgggcaggucgccacguucacccugaucgagcaggacggcuccgccuacgugcccggggaccgggcggcgccccugggcuacccggacuucagcggccagcucgagaucgaggugcagaccgagaccacgaaggccggggacaagcugaaggucaccaccuucgagaugauccugggccccaccacgaacguggaccaggcccccuaccaggggcgcguguacgccagccucgccgucgccgccucccuggaccugguggacggccgggugcgcgccgucccccggagcauccacggguuccaggacgugaucccggaguacaacgacggccuccuggugccccuggcgccgcccaucggccccuuccuccccggggagguccugcugcgcuuccggaccuacaugcgccagcucgacaccgccgacgccgccgccgaggcgaucgacugcgcccugccccaggaguucaucuccugguucgccagcaacgccuucaccgugcaguccgacgcccugcuccugcgguaccgcaacacgcugaccggccagcuccuguucgagugcaagcuguacagcgagggguacaucgcgcuguccuacagcggcuccgggccccucaccuucccgaccgacggcuucuucgagguggucagcugggugccccgccuguuccagcuggccuccgugggcagccucgccacggggcggacccugaagcaguga
